US012584146B2

(12) United States Patent
Diamond et al.

(10) Patent No.: US 12,584,146 B2
(45) Date of Patent: *Mar. 24, 2026

(54) SYNTHETIC MODIFIED VACCINIA ANKARA (SMVA) BASED CORONAVIRUS VACCINES

(71) Applicant: CITY OF HOPE, Duarte, CA (US)

(72) Inventors: Don J. Diamond, Glendora, CA (US); Felix Wussow, Glendora, CA (US); Flavia Chiuppesi, Duarte, CA (US)

(73) Assignee: CITY OF HOPE, Duarte, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 19/183,257

(22) Filed: Apr. 18, 2025

(65) Prior Publication Data

US 2025/0313858 A1 Oct. 9, 2025

Related U.S. Application Data

(63) Continuation of application No. 17/999,170, filed as application No. PCT/US2021/032821 on May 17, 2021.

(60) Provisional application No. 63/161,371, filed on Mar. 15, 2021, provisional application No. 63/113,810, filed on Nov. 13, 2020, provisional application No. 63/044,033, filed on Jun. 25, 2020, provisional application No. 63/026,127, filed on May 17, 2020.

(51) Int. Cl.
| | |
|---|---|
| *C12N 15/86* | (2006.01) |
| *A61K 39/00* | (2006.01) |
| *A61K 39/215* | (2006.01) |
| *A61P 31/14* | (2006.01) |
| *C07K 14/005* | (2006.01) |

(52) U.S. Cl.
CPC ............ *C12N 15/86* (2013.01); *A61K 39/215* (2013.01); *A61P 31/14* (2018.01); *C07K 14/005* (2013.01); *A61K 2039/53* (2013.01); *A61K 2039/575* (2013.01); *C07K 2319/02* (2013.01); *C07K 2319/03* (2013.01); *C12N 2710/24143* (2013.01); *C12N 2710/24171* (2013.01); *C12N 2770/20022* (2013.01); *C12N 2770/20034* (2013.01); *C12N 2770/20071* (2013.01)

(58) Field of Classification Search
CPC .......... C12N 15/86; C12N 2710/24143; C12N 2710/24171; C12N 2770/20022; C12N 2770/20034; C12N 2770/20071; C12N 15/00; A61K 39/215; A61K 2039/53; A61K 2039/575; A61K 2039/545; A61K 2039/572; A61K 39/12; A61P 31/14; C07K 14/005; C07K 2319/02; C07K 2319/03

See application file for complete search history.

(56) References Cited

U.S. PATENT DOCUMENTS

| | | | |
|---|---|---|---|
| 11,202,753 B1 * | 12/2021 | Chang ................. | A61M 5/2033 |
| 2004/0014034 A1 | 1/2004 | Evans et al. | |
| 2007/0092936 A1 | 4/2007 | Haynes et al. | |
| 2007/0275010 A1 | 11/2007 | Feinberg et al. | |
| 2010/0136056 A1 | 6/2010 | Panicali et al. | |
| 2012/0263750 A1 | 10/2012 | Moss et al. | |
| 2017/0340687 A1 | 11/2017 | Nakao et al. | |
| 2018/0251736 A1 | 9/2018 | Evans et al. | |
| 2020/0071724 A1 | 3/2020 | Moss et al. | |
| 2020/0138923 A1 | 5/2020 | Bendjama et al. | |
| 2021/0260180 A1 * | 8/2021 | Georges ............... | C07K 14/005 |
| 2021/0260181 A1 * | 8/2021 | Georges .................. | A61K 9/12 |
| 2021/0260182 A1 * | 8/2021 | Lederman ............... | A61P 31/14 |
| 2021/0283242 A1 * | 9/2021 | Hutchins ............... | C07K 14/47 |
| 2021/0299245 A1 | 9/2021 | Prow et al. | |
| 2022/0370600 A1 * | 11/2022 | Hu .......................... | A61K 39/39 |

FOREIGN PATENT DOCUMENTS

| | | |
|---|---|---|
| EP | 3045181 B1 | 11/2018 |
| WO | 2006/071250 A2 | 7/2006 |
| WO | 2016/116398 A1 | 7/2016 |
| WO | 2018/085582 | 5/2018 |
| WO | 2019/213452 A1 | 11/2019 |
| WO | 2021/155323 | 8/2021 |

(Continued)

OTHER PUBLICATIONS

Ahmed, S. F., et al., "Vaccinia virus vaccination is expected to elicit highly cross-reactive immunity to the 2022 monkeypox virus," BioRxiv, doi:10.1101/2022.06.23.497143 (2022), 18 pages.

(Continued)

*Primary Examiner* — Rachel B Gill
(74) *Attorney, Agent, or Firm* — Perkins Coie LLP; Lara J. Dueppen

(57) ABSTRACT

Synthetic MVA-based vaccine compositions for preventing or treating a virus infection such as a coronavirus infection and methods of producing the vaccines. The vaccine compositions include (i) either a single DNA fragment that includes the entire genome of MVA, or two or more DNA fragments, each including a partial sequence of the genome of the MVA such that the two or more DNA fragments, when expressed in the host cell upon co-transfection, are assembled sequentially and comprise the full-length sequence of the MVA genome, and (ii) one or more DNA sequences encoding one or more human coronavirus antigens, subunits, or fragments thereof inserted in one or more insertion sites of the MVA. The antigens, subunits, or fragments thereof are expressed in the host cell upon transfection of the one or more DNA fragments.

24 Claims, 237 Drawing Sheets

Specification includes a Sequence Listing.

(56)                References Cited

FOREIGN PATENT DOCUMENTS

| WO | 2021/156267 A1 | 8/2021 |
| WO | 2021/158565 A2 | 8/2021 |
| WO | 2021/163622 | 8/2021 |
| WO | 2021/165667 | 8/2021 |
| WO | 2021/174142 A1 | 9/2021 |
| WO | 2021/181100 | 9/2021 |
| WO | 2021/216743 A2 | 10/2021 |
| WO | 2021/236550 A1 | 11/2021 |

OTHER PUBLICATIONS

Aldoss, I., et al., "Poxvirus vectored cytomegalovirus vaccine to prevent cytomegalovirus viremia in transplant recipients: A phase 2, randomized clinical trial," Ann. Intern. Med. (2020) 172(5):306-316.

Alharbi, N. K., "Poxviral promoters for improving the immunogenicity of MVA delivered vaccines," Hum. Vaccines Immunother. (2019) 15(1):203-209.

Alharbi, et al. "ChAdOx1 and MVA based vaccine candidates against MERS-CoV elicit neutralising antibodies and cellular immune responses in mice" Vaccine 35 (2017), Elsevier Accepted May 10, 2017, 10 pages.

Amara, R. R., et al., "Long-lived poxvirus immunity, robust CD4 help, and better persistence of CD4 than CD8 T cells," J. Virol. (2004) 78:3811-3816.

Americo, J. L., et al., "Virulence differences of mpox (monkeypox) virus clades I, IIa, and IIb.1 in a small animal model," Proc. Natl. Acad. Sci. USA (2023) 120:e2220415120.

Anderson, S. G., et al., "The international standard for anti-smallpox serum," Bull. World Health Organ. (1970) 42:515-523.

Antoine, G., et al., "The complete genomic sequence of the modified vaccinia ankara strain: Comparison with other orthopoxviruses," Virology (1998) 244(2):365-396.

Bachmann, M. F., et al., "Functional properties and lineage relationship of CD8+ T cell subsets identified by expression of IL-7 receptor alpha and CD62L," J. Immunol. (2005) 175:4686-4696.

Baden, L. R., et al., "Efficacy and safety of the mRNA-1273 SARS-CoV-2 Vaccine," N. Engl. J. Med. (2021) 384:403-416.

Bagarazzi, M. L., et al., "Immunotherapy against HPV16/18 generates potent TH1 and cytotoxic cellular immune responses," Sci. Transl. Med. (2012) 4(155):155ra138.

Bange, E. M., et al.. "CD8+ T cells contribute to survival in patients with COVID-19 and hematologic cancer," Nat. Med. (2021) 27(7):1280-1289.

Baroudy, B. M., et al., "Structure and replication of vaccinia virus telomeres," Cold Spring Harbor symposia on quantitative biology (1983) 47 (Pt 2):723-729.

Baxby, D., "Studies in smallpox and vaccination," Rev. Med. Virol. (2002) 12:201-209.

Bayarri-Olmos, R., et al., "The alpha/B.1.1.7 SARS-CoV-2 variant exhibits significantly higher affinity for ACE-2 and requires lower inoculation doses to cause disease in K18-hACE2 mice," eLife (2021) 10:e70002, 14 pages.

Beer, E. M., et al., "A systematic review of the epidemiology of human monkeypox outbreaks and implications for outbreak strategy," PLoS Negl. Trop Dis. (2019) 13:e0007791.

Birnboim, H. C., et al., "A rapid alkaline extraction procedure for screening recombinant plasmid DNA," Nucl. Acids Res. (1979) 7:1513-1523.

Bisht et al. "Severe acute respiratory syndrome coronavirus spike protein expressed by attenuated vaccinia virus protectively immunizes mice", PNAS Apr. 27, 2004, vol. 101, No. 17, 6 pages.

Bray, M., et al., "Progressive vaccinia," Clin. Infect. Dis. (2003) 36:766-774.

Bunge, E. M., et al., "The changing epidemiology of human monkeypox—a potential threat? A systematic review," PLoS Negl. Trop. Dis. (2022) 16:e0010141.

Carroll, M. W., et al., "Host range and cytopathogenicity of the highly attenuated MVA strain of vaccinia virus: Propagation and generation of recombinant viruses in a nonhuman mammalian cell line," Virol. (1997) 238:198-211.

Chan, J. F., et al., "Simulation of the clinical and pathological manifestations of coronavirus disease 2019 (COVID-19) in a golden syrian hamster model: Implications for disease pathogenesis and transmissibility," Clin. Infect. Dis. (2020) 71:2428-2446.

Chandrashekar, A., et al., "SARS-CoV-2 infection protects against rechallenge in rhesus macaques," Science (2020) 369:812-817.

Chappell, K. J., et al., "Safety and immunogenicity of an MF59-adjuvanted spike glycoprotein-clamp vaccine for SARS-CoV-2: a randomised, double- blind, placebo-controlled, phase 1 trial," Lancet Infect. Dis. (2021) 21:1383-1394.

Chiuppesi, F., et al., "Multiantigenic modified vaccinia virus ankara vaccine vectors to elicit potent humoral and cellular immune reponses against human cytomegalovirus in mice," J. Virol. (2018) 92:e01012-01018.

Chiuppesi, F., et al., "Development of a multi-antigenic SARS-CoV-2 vaccine candidate using a synthetic poxvirus platform," Nat. Commun. (2020) 11:6121, 16 pages.

Chiuppesi, et al. "Synthetic Multiantigen MVA Vaccine COH04S1 Protects Against SARS-CoV-2 in Syrian Hamsters and Non-Human Primates" Sep. 15, 2021, bioRxiv preprint doi: https://doi.org/10.1101/2021.09.15.460487; 42 pages.

Chiuppesi, F., et al., "Vaccine-induced spike- and nucleocapsid-specific cellular responses maintain potent cross-reactivity to SARS-CoV-2 Delta and Omicron variants," iScience (2022) 25:104745, 15 pages.

Chiupppesi, F., et al., "Safety and immunogenicity of a synthetic multiantigen modified vaccinia virus Ankara-based COVID-19 vaccine (COH04S1): an open-label and randomized, phase 1 trial," Lancet Microbe (2022) 3:e252-e264.

Chiuppesi, F., et al., "Synthetic modified vaccinia Ankara vaccines confer potent monkeypox immunity in non-human primates and healthy adults," medRxiv (2022) https://doi.org/10.1101/2022.07.26.22277958, 38 pages.

Chiuppesi, F., et al., "Synthetic multiantigen MVA vaccine COH04S1 protects against SARS-CoV-2 in Syrian hamsters and non-human primates," NPJ Vaccines (2022) 7:7, 14 pages.

Corbett, K. S., et al., "Evaluation of the mRNA-1273 vaccine against SARS-CoV-2 in nonhuman primates," N. Engl. J. Med. (2020) 383:1544- 1555.

Cottingham, M. G., et al., "Recombination-mediated genetic engineering of a bacterial artificial chromosome clone of modified vaccinia virus Ankara (MVA)," PLoS One (2008) 3:e1638, 9 pages.

Cottingham, M. G., et al., "Recombinant MVA vaccines: dispelling the myths," Vaccine (2013) 31:4247-4251.

Cox, R. J., et al., "Not just antibodies: B cells and T cells mediate immunity to COVID-19," Nat. Rev. Immunol. (2020) 20:581-582.

Crawford, K. H. D., et al., "Protocol and reagents for pseudotyping lentiviral particles with SARS-CoV-2 spike protein for neutralization assays," Viruses (2020) 12:513, 15 pages.

Cross R. W., et al., "Intranasal exposure of African green monkeys to SARS-CoV-2 results in acute phase pneumonia with shedding and lung injury still present in the early convalescence phase," Virol. J. (2020) 17:125, 12 pages.

Crotty, S. et al., "Cutting edge: long-term B cell memory in humans after smallpox vaccination," J. Immunol. (2003) 171:4969-4973.

Czub, M., et al., "Evaluation of modified vaccinia virus Ankara based recombinant SARS vaccine in ferrets," Vaccine (2005) 23:2273-2279.

Dagnew, A. F., et al., "Immunogenicity and safety of the adjuvanted recombinant zoster vaccine in adults with haematological malignancies: a phase 3, randomised, clinical trial and post-hoc efficacy analysis," Lancet Infect. Dis. (2019) 19: 988-1000.

Dangi, T., et al., "Combining spike- and nucleocapsid-based vaccines improves distal control of SARS-CoV-2," Cell. Rep. (2021) 36(10):109664.

Davies, D. H., et al., "Vaccinia virus H3L envelope protein is a major target of neutralizing antibodies in humans and elicits protection against lethal challenge in mice," J. Virol. (2005) 79:11724-11733.

(56) References Cited

OTHER PUBLICATIONS

Dejnirattisai, W., et al., "Antibody evasion by the P.1 strain of SARS-CoV-2," Cell (2021) 184:2939-2954.

Delange, A. M., et al., "Replication and resolution of cloned poxvirus telomeres in vivo generates linear minichromosomes with intact viral hairpin termini," J. Virol. (1986) 59:249-259.

Delange, A. M., et al., "Efficient resolution of replicated poxvirus telomeres to native hairpin structures requires two inverted symmetrical copies of a core target DNA sequence," J. Virol. (1987) 61:1957-1963.

Deputy, N. P., et al., "Vaccine effectiveness of JYNNEOS against Mpox disease in the United States," N. Engl. J. Med. (2023) 388:2434-2443.

Domi, A., et al., "Cloning the vaccinia virus genome as a bacterial artificial chromosome in Escherichia coli and recovery of infectious virus in mammalian cells," Proc. Natl. Acad. Sci. U.S.A. (2002) 99:12415-12420.

Durski, K. N., et al., "Emergence of Monkeypox—West and Central Africa, 1970-2017," MMWR Morb. Mortal. Wkly. Rep. (2018) 67:306-310.

Dutta, N. K., et al., "The nucleocapsid protein of SARS-CoV-2: a target for vaccine development," J. Virol. (2020) 94(13)1-2.

Earl, P. L. et al., "Immunogenicity of a highly attenuated MVA smallpox vaccine and protection against monkeypox," Nature (2004) 428:182-185.

Earl, P. L., et al., "Recombinant modified vaccinia virus Ankara provides durable protection against disease caused by an immunodeficiency virus as well as long-term immunity to an orthopoxvirus in a non-human primate," Virol. (2007) 366:84-97.

Earl, P. L., et al., "Rapid protection in a monkeypox model by a single injection of a replication-deficient vaccinia virus," Proc. Natl. Acad. Sci. USA (2008) 105(31):10889-10894.

Earl, P. L., et al., "Generation of recombinant vaccinia viruses," Curr. Protoc. Mol. Biol. (2018) 89:5.13.1-5.13.18.

Edara, V.V., et al., "Infection and vaccine-induced neutralizing-antibody responses to the SARS-CoV-2 B.1.617 Variants," N. Engl. J. Med. (2021) 385(7):664-666.

Edghill-Smith, Y., et al., "Smallpox vaccine-induced antibodies are necessary and sufficient for protection against monkeypox virus," Nat. Med. (2005) 11:740-747.

Epker, J. L., et al., "Double data and dubious conclusions, Houston do we have a problem?" Intensive Care Med. (2021) 47:487-488.

European Patent Office, Extended European Search Report and Opinion dated Jun. 12, 2024 for European Patent Application No. 21809653.5, 12 pages.

Falsey, A, R,, et al., "SARS-CoV-2 neutralization with BNT162b2 vaccine dose 3," N. Engl. J. Med. (2021) 385(17):1627-1629.

Faria, N. R., et al., "Genomics and epidemiology of the P.1 SARS-CoV-2 lineage in Manaus, Brazil," Science (2021) 372:815-821.

Fenner, F., "The global eradication of smallpox," Med. J. Aust. (1980) 1:455-456.

The Fenway Institute, "HHS Orders 2.5 Million More Doses of JYNNEOS Vaccine for Monkeypox Preparedness," doi:https://www.hhs.gov/about/news/2022/07/01/hhs-orders-2-point-5-million-more-doses-jynneos-vaccine-for-monkeypox-preparedness.html (2022), 34 pages.

Fernandez, J., et al., "Neutralization of alpha, gamma, and D614G SARS-CoV-2 variants by CoronaVac vaccine-induced antibodies," J. Med. Virol. (2022) 94:399-403.

Ferretti, A. P., et al., "Unbiased screens show CD8+ T cells of COVID-19 patients recognize shared epitopes in SARS-COV-2 that largely reside outside the spike protein," Immunity (2020) 53(5):1095-1107.

Flaxman, A., et al., "Reactogenicity and immunogenicity after a late second dose or a third dose of ChAdOx1 nCoV-19 in the UK: a substudy of two randomised controlled trials (COV001 and COV002)," Lancet (2021) 398(10304):981-90.

Forster, R., et al., "Combating COVID-19: MVA vector vaccines applied to the respiratory tract as promising approach toward protective immunity in the lung," Front. Immunol. (2020) 11:1959.

Frankel, P. H., et al., "Model of a queuing approach for patient accrual in phase 1 oncology studies," JAMA Netw. Open (2020) 3(5):e204787, 13 pages.

Frey, S. E., et al., "Clinical and immunologic responses to multiple doses of IMVAMUNE (Modified Vaccinia Ankara) followed by Dryvax challenge," Vaccine (2007) 25:8562-8573.

Gao, Y., et al., "Ancestral SARS-CoV-2-specific T cells cross-recognize the Omicron variant," Nat. Med. (2022) 28:472-476.

Garcia-Arriaza, J., et al., "COVID-19 vaccine candidates based on modified vaccinia virus Ankara expressing the SARS-CoV-2 spike induce robust T- and B-cell immune responses and full efficacy in mice," J. Virol. (2021) 95(7):e02260-20, 22 pages.

Garcia-Beltran, W. F., et al., "Multiple SARS-CoV-2 variants escape neutralization by vaccine-induced humoral immunity," Cell (2021) 184:2372-2383.E1-E9.

Geers, D., et al., "SARS-CoV-2 variants of concern partially escape humoral but not T-cell responses in COVID-19 convalescent donors and vaccine recipients," Sci. Immunol. (2021) 6:eabj1750, 14 pages.

GenBank, "Severe acute respiratory syndrome coronavirus 2 isolate Wuhan-Hu-1, complete genome," NCBI Reference Sequence: NC_045512.2, Jul. 18, 2020, 15 pages.

GenBank, "Synthetic construct clone C35/41, complete sequence," GenBank: MW036243.1, Oct. 28, 2020, 50 pages.

Gilbert, S.C., "Clinical development of Modified Vaccinia virus Ankara vaccines," Vaccine (2013) 31:4241-4246.

Goepfert, P. A., et al., "Safety and immunogenicity of SARS-CoV-2 recombinant protein vaccine formulations in healthy adults: interim results of a randomised, placebo-controlled, phase 1-2, dose-ranging study," Lancet Infect. Dis. (2021) 21(9):1257-1270.

Goni, J. R., et al., "Determining promoter location based on DNA structure first-principles calculations," Genome Biol. (2007) 8:R263, 10 pages.

Goonetilleke, N., et al., "Induction of multifunctional human immunodeficiency virus type 1 (HIV-1)-specific T cells capable of proliferation in healthy subjects by using a prime-boost regimen of DNA- and modified vaccinia virus Ankara-vectored vaccines expressing HIV-1 Gag coupled to CD8+ T-cell epitopes," J. Virol. (2006) 80(10):4717-4728.

Graham, B. S., "+A72Rapid COVID-19 vaccine development: Finding the fastest pathway to vaccine availability includes the avoidance of safety pitfalls," Science (2020) 368:945-946.

Grifoni, A., et al., "Targets of T cell responses to SARS-CoV-2 coronavirus in humans with COVID-19 disease and unexposed individuals," Cell (2020) 181(7):1489-1501.

Haagmans, B. L., et al., "An orthopoxvirus-based vaccine reduces virus excretion after MERS-CoV infection in dromedary camels," Science (2016) 351:77-81.

Haas, E. J., et al., "Infections, hospitalisations, and deaths averted via a nationwide vaccination campaign using the Pfizer-BioNTech BNT162b2 mRNA COVID-19 vaccine in Israel: a retrospective surveillance study," Lancet Infect. Dis. (2022) 22:357-366.

Halle, S., et al., "Induced bronchus-associated lymphoid tissue serves as a general priming site for T cells and is maintained by dendritic cells," J. Exp. Med. (2009) 206(12):2593-2601.

Harris, P. E., et al., "A synthetic peptide CTL vaccine targeting nucleocapsid confers protection from SARS-CoV-2 challenge in rhesus macaques," Vaccines (2021) 9:520, 23 pages.

Heath, P. T., et al., "Safety and efficacy of NVX-CoV2373 Covid-19 vaccine," N. Engl. J. Med. (2021) 385(13):1172-1183.

Hoffmann, M., et al., "SARS-CoV-2 cell entry depends on ACE2 and TMPRSS2 and is blocked by a clinically proven protease inhibitor," Cell (2020) 181:271-280.

Hong, S. H., et al., "Immunization with RBD-P2 and N protects against SARS-CoV-2 in nonhuman primates," Sci. Adv. (2021) 7:eabg7156, 10 pages.

Hooper, J. W., et al., "DNA vaccination with vaccinia virus L1R and A33R genes protects mice against a lethal poxvirus challenge," Virol. (2000) 266:329-339.

(56)          References Cited

OTHER PUBLICATIONS

Hooper, J. W., et al., "Four-gene-combination DNA vaccine protects mice against a lethal vaccinia virus challenge and elicits appropriate antibody responses in nonhuman primates," Virol. (2003) 306:181-195.

Hubert, M., et al., "Complement-dependent mpox-virus-neutralizing antibodies in infected and vaccinated individuals," Cell Host Microbe (2023) 31:937-948.

Ichihashi, Y., "Extracellular enveloped vaccinia virus escapes neutralization," Virol. (1996) 217:478-485.

Imai, M., et al., "Syrian hamsters as a small animal model for SARS-CoV-2 infection and countermeasure development," Proc. Natl. Acad. Sci. USA (2020) 117(28):16587-16595.

Iwasaki, A., "The potential danger of suboptimal antibody responses in COVID-19," Nat. Rev. Immunol. (2020) 20:339-341.

Jacobs, B. L., et al., "Vaccinia virus vaccines: past, present and future," Antiviral Res. (2009) 84:1-13.

Jaume, M., et al., "Anti-severe acute respiratory syndrome coronavirus spike antibodies trigger infection of human immune cells via a pH- and cysteine protease-independent FcgammaR pathway," J. Virol. (2011) 85:10582-10597.

Koch, T., et al., "Safety and immunogenicity of a modified vaccinia virus Ankara vector vaccine candidate for Middle East respiratory syndrome: an open-label, phase 1 trial," Lancet Infect. Dis. (2020) 20:827-838.

Kozlov, M., "Can vaccines contain the global monkeypox outbreaks?" Nature (2022) 606:444-445.

Krammer, F., "SARS-CoV-2 vaccines in development," Nature (2020) 586:516-527.

Krammer, F., "Correlates of protection from SARS-CoV-2 infection," Lancet (2021) 397:1421-1423.

Krause, P. R., et al., "SARS-CoV-2 variants and vaccines," N. Engl. J. Med. (2021) 385(2):179-186, 8 pages.

Kristiansen, P. A., et al., "WHO international standard for anti-SARS-CoV-2 immunoglobulin," Lancet (2021) 397(10282):1347-1348.

Kustin, T., et al., "Evidence for increased breakthrough rates of SARS-CoV-2 variants of concern in BNT162b2-mRNA-vaccinated individuals," Nat. Med. (2021) 27(8):1379-1384.

La Rosa, C., et al., "MVA vaccine encoding CMV antigens safely induces durable expansion of CMV-specific T cells in healthy adults," Blood (2017) 129:114-125.

Liang, W., et al., "Cancer patients in SARS-CoV-2 infection: a nationwide analysis in China," Lancet Oncol. (2020) 21:335-337.

Liu, R., et al., "One or two injections of MVA-vectored vaccine shields hACE2 transgenic mice from SARS-CoV-2 upper and lower respiratory tract infection," Proc. Natl. Acad. Sci. USA (2021) 118(12):2026785118, 11 pages.

Liu, Y., et al., "BNT162b2-elicited neutralization against new SARS-CoV-2 spike variants," N. Engl. J. Med. (2021) 385(5):472-474.

Logunov, D. Y., et al., "Safety and efficacy of an rAd26 and rAd5 vector-based heterologous prime-boost COVID-19 vaccine: an interim analysis of a randomised controlled phase 3 trial in Russia," Lancet (2021) 397:671-681.

Long, Q. X., et al., "Antibody responses to SARS-CoV-2 in patients with COVID-19," Nat. Med. (2020) 26:845-848.

Lopez Bernal, J., et al., "Effectiveness of Covid-19 vaccines against the B.1.617.2 (delta) variant," N. Engl. J. Med. (2021) 385(7):585-594.

Lurie, N., et al., "Developing Covid-19 vaccines at pandemic speed," New Engl. J. Med. (2020) 382(21):1969-1973.

Madhi, S. A., et al., "Efficacy of the ChAdOx1 nCoV-19 Covid-19 vaccine against the B.1.351 variant," N. Engl. J. Med. (2021) 384(20):1885-1898.

Matchett, W. E., et al., "Nucleocapsid vaccine elicits spike-independent SARS-CoV-2 protective immunity," J. Immunol. (2021) 207(2):376-379.

McMahan, K., et al., "Correlates of protection against SARS-CoV-2 in rhesus macaques," Nature (2021) 590(7847):630-634.

Meisinger-Henschel, C., et al., "Genomic sequence of chorioallantois vaccinia virus Ankara, the ancestor of modified vaccinia virus Ankara," J. Gen. Virol. (2007) 88:3249-3259.

Merchlinsky, M., et al., "Resolution of linear minichromosomes with hairpin ends from circular plasmids containing vaccinia virus concatemer junctions," Cell (1986) 45:879-884.

Merchlinsky, M., et al., "Molecular cloning and sequence of the concatemer junction from vaccinia virus replicative DNA. Viral nuclease cleavage sites in cruciform structures," J. Mol. Biol. (1988) 199:399-413.

Merchlinsky, M., "Mutational analysis of the resolution sequence of vaccinia virus DNA: essential sequence consists of two separate AT-rich regions highly conserved among poxviruses," J. Virol. (1990) 64:5029-5035.

Miller, J. D., et al., "Human effector and memory CD8+ T cell responses to smallpox and yellow fever vaccines," Immunity (2008) 28:710-722.

Millet, J. K., et al., "Production of pseudotyped particles to study highly pathogenic coronaviruses in a biosafety level 2 setting," J. Vis. Exp. (2019) 1:(145):10.3791/59010.

Mitja, O., et al., "Monkeypox," Lancet (2023) 401:60-74.

Moore, J. P., et al., "SARS-CoV-2 vaccines and the growing threat of viral variants," JAMA (2021) 325(9):821-822.

Moss, B., "Smallpox vaccines: targets of protective immunity," Immunol. Rev. (2011) 239:8-26.

Moss, B., "Poxvirus DNA replication," Cold Spring Harb. Perspect. Biol. (2013) 5:a010199, 12 pages.

Mukherjee, et al., "Global efforts on vaccines for COVID-19: Since, sooner or later, we all will catch the coronavirus," J. Biosci. (2020) 45:68, 10 pages.

Munster, V. J., et al., "Respiratory disease in rhesus macaques inoculated with SARS-CoV-2," Nature (2020) 585(7824):268-272.

Neidleman, J., et al., "SARS-CoV-2-specific T cells exhibit phenotypic features of helper function, lack of terminal differentiation, and high proliferation potential," Cell. Rep. Med. (2020) 1:100081, 17 pages.

Ni, L., et al., "Detection of SARS-CoV-2-specific humoral and cellular immunity in COVID-19 convalescent individuals," Immunity (2020) 52:971-977.

Niwa, H., et al., "Efficient selection for high-expression transfectants with a novel eukaryotic vector," Gene (1991) 108:193-199.

Noyce, R. S., et al., "Construction of an infectious horsepox virus vaccine from chemically synthesized DNA fragments," PLoS One (2018) 13(1):e0188453, 16 pages.

Ou, X., et al., "Characterization of spike glycoprotein of SARS-CoV-2 on virus entry and its immune cross-reactivity with SARS-CoV," Nat. Commun. (2020) 11:1620, 12 pages.

Padron-Regalado, E., Vaccines for SARS-COV-2: Lessons from other coronavirus strains, Infect. Dis. Ther. (2020) 9:255-274.

Peng, Y., et al., "Broad and strong memory CD4+ and CD8+ T cells induced by SARS-CoV-2 in UK convalescent individuals following COVID-19," Nat. Immunol. (2020) 21:1336-1345.

Pittman, P. R., et al., "Phase 3 efficacy trial of modified vaccinia ankara as a vaccine against smallpox," N. Engl. J. Med. (2019) 381(20):1897-1908.

Planas, D., et al., "Reduced sensitivity of SARS-CoV-2 variant delta to antibody neutralization," Nature (2021) 596(7871):276-280, 20 pages.

Polack, F. P., et al., "Safety and efficacy of the BNT162b2 mRNA Covid-19 vaccine," N. Engl. J. Med. (2020) 383:2603-2615.

Premkumar, L., et al., "The receptor binding domain of the viral spike protein is an immunodominant and highly specific target of antibodies in SARS-CoV-2 patients," Sci. Immunol. (2020) 10.1126/sciimmunol.abc8413, 14 pages.

Puissant, B., et al., "Keeping the memory of smallpox virus," Cell. Mol. Life Sci. (2006) 63:2249-2259.

Redd, A. D., et al., "CD8+ T-cell responses in COVID-19 convalescent individuals target conserved epitopes from multiple prominent SARS-CoV-2 circulating variants," Open Forum Infect. Dis. (2021) 8(7):ofab143, 3 pages.

Rice, A., et al., "Intranasal plus subcutaneous prime vaccination with a dual antigen COVID-19 vaccine elicits T-cell and antibody responses in mice," Sci. Rep. (2021) 11:14917, 15 pages.

(56) References Cited

OTHER PUBLICATIONS

Rimoin, A. W., et al., "Major increase in human monkeypox incidence 30 years after smallpox vaccination campaigns cease in the Democratic Republic of Congo," Proc. Natl. Acad. Sci. USA (2010) 107(37):16262-16267.

Robinson, H. L., et al., "Studies on GM-CSF DNA as an adjuvant for neutralizing Ab elicited by a DNA/MVA immunodeficiency virus vaccine," Virol. (2006) 352:285-294.

Rogers, T. F., et al., "Isolation of potent SARS-CoV-2 neutralizing antibodies and protection from disease in a small animal model," Science (2020) 369:956-963.

Routhu, N. K., et al., "A modified vaccinia Ankara vector-based vaccine protects macaques from SARS-CoV-2 infection, immune pathology, and dysfunction in the lungs," (2021) Immunity 54:542-556.

Rubin, L. G., et al., "2013 IDSA clinical practice guideline for vaccination of the immunocompromised host," Clin. Infect. Dis. (2014) 58(3):309-318.

Rydyznski, C., et al., "Antigen-specific adaptive immunity to SARS-CoV-2 in acute COVID-19 and associations with age and disease severity," Cell (2020) 183(4):996-1012.

Sadoff, J., et al., "Safety and efficacy of single-dose Ad26.COV2.S vaccine against Covid-19," N. Engl. J. Med. (2021) 384(23):2187-2201.

Sanchez-Felipe, L., et al., "A single-dose live-attenuated YF17D-vectored SARS-CoV-2 vaccine candidate," Nature (2021) 590:320-325.

Sanders, J. M., et al., "Pharmacologic treatments for coronavirus disease 2019 (COVID-19): a review," JAMA (2020) 323(18):1824-1836.

Santra, S., et al., "Heterologous prime/boost immunization of rhesus monkeys by using diverse poxvirus vectors," J. Virol. (2007) 81(16):8563-8570.

Scheiflinger, F., et al., "Construction of chimeric vaccinia viruses by molecular cloning and packaging," Proc. Natl. Acad. Sci. USA (1992) 89(21):9977-9981.

Seaman, M. S., et al., "Effect of immunization with modified vaccinia Ankara (ACAM3000) on subsequent challenge with Dryvax," J. Infect. Dis. (2010) 201(9):1353-1360.

Sekine, T., et al., "Robust T cell immunity in convalescent individuals with asymptomatic or mild COVID-19," Cell (2020) 183(1):158-168.

Sekine, T., et al., "TOX is expressed by exhausted and polyfunctional human effector memory CD8+ T cells," Sci. Immunol. (2020) 5:eaba7918, 14 pages.

Shi, Y., et al., "An overview of COVID-19," J. Zhejiang Univ-Sci B (Biomed & Biotechnol) (2020) 21(5):343-360.

Shinde, V., et al., "Efficacy of NVX-CoV2373 Covid-19 vaccine against the B.1.351 variant," N. Engl. J. Med. (2021) 384(20):1899-1909.

Sia, S. F., et al., "Pathogenesis and transmission of SARS-CoV-2 in golden hamsters," Nature (2020) 583(7818):834-838.

Smith, G. L., et al., "The formation and function of extracellular enveloped vaccinia virus," J. Gen. Virol. (2002) 83:2915-2931.

Smith, T. R. F. et al., "Immunogenicity of a DNA vaccine candidate for COVID-19," Nat. Commun. (2020) 11:2601, 13 pages.

Stittelaar, K. J., et al., "Modified vaccinia virus Ankara protects macaques against respiratory challenge with monkeypox virus," J. Virol. (2005) 79:7845-7851.

Sutter, G., et al., "Nonreplicating vaccinia vector efficiently expresses recombinant genes," Proc. Natl. Acad. Sci. USA (1992) 89:10847-10851.

Tai, W., et al., "Characterization of the receptor-binding domain (RBD) of 2019 novel coronavirus: implication for development of RBD protein as a viral attachment inhibitor and vaccine," Cell. Mol. Immunol. (2029( 17:613-620.

Tamari, R., et al., "Predictors of humoral response to SARS-CoV-2 vaccination after hematopoietic cell transplantation and CAR T-cell therapy," Blood Cancer Discov. (2021) 2:577-585.

Tarke, A., et al., "Comprehensive analysis of T cell immunodominance and immunoprevalence of SARS-CoV-2 epitopes in COVID-19 cases," Cell. Rep. Med. (2021) 2(2):100204, 20 pages.

Tarke, A., et al., "Impact of SARS-CoV-2 variants on the total CD4+ and CD8+ T cell reactivity in infected or vaccinated individuals," Cell. Rep. Med. (2021) 2(7):100355, 17 pages.

Tay, M. Z., et al., "The trinity of COVID-19: immunity, inflammation and intervention," Nat. Rev. Immunol. (2020) 20:363-374.

Taylor, J., et al., "Protective immunity against avian influenza induced by a fowlpox virus recombinant," Vaccine (1988) 6:504-508.

Tegally, H., et al., "Detection of a SARS-CoV-2 variant of concern in South Africa," Nature (2021) 592:438-443.

Tischer, B. K., et al., "Two-step red-mediated recombination for versatile high-efficiency markerless DNA manipulation in *Escherichia coli*," Biotechniques (2006) 40(2):191-197.

Tischer, B. K., et al., "En passant mutagenesis: a two step markerless red recombination system," Meth. Mol. Biol. (2010) 634:421-430.

Tomaras, G. D., et al., "Vaccine-induced plasma IgA specific for the C1 region of the HIV-1 envelope blocks binding and effector function of IgG," Proc. Natl. Acad. Sci. USA (2013) 110(22):9019-9024.

Tostanoski, L. H., et al., "Ad26 vaccine protects against SARS-CoV-2 severe clinical disease in hamsters," Nat. Med. (2020) 26:1694-1700.

Tscharke, D. C., et al., "Identification of poxvirus CD8+ T cell determinants to enable rational design and characterization of smallpox vaccines," J. Ex. Med. (2005) 201(1):95-104.

Tscherne, A., et al., "Immunogenicity and efficacy of the COVID-19 candidate vector vaccine MVA-SARS-2-S in preclinical vaccination," Proc. Natl. Acad. Sci. USA (2021) 118:e2026207118, 9 pages.

Tse, L. V., et al., "The current and future state of vaccines, antivirals and gene therapies against emerging coronaviruses," Front. Microbiol. (2020) 11:658, 26 pages.

United States Patent and Trademark Office, International Search Report and Written Opinion dated Oct. 21, 2021 for PCT/US21/32821, 16 pages.

United States Patent and Trademark Office, International Search Report and Written Opinion dated Feb. 22, 2023 for PCT/US22/80073, 16 pages.

United States Patent and Trademark Office, Invitation to Pay Additional Fees and, Where Applicable, Protest Fee dated Feb. 27, 2023 for PCT/US22/80068, 2 pages.

United States Patent and Trademark Office, International Search Report and Written Opinion dated Apr. 6, 2023 for PCT/US22/80065, 9 pages.

United States Patent and Trademark Office, International Search Report and Written Opinion dated May 2, 2023 for PCT/US22/80068, 12 pages.

United States Patent and Trademark Office, International Search Report and Written Opinion dated Nov. 22, 2023 for PCTUS23/070704, 12 pages.

United States Patent and Trademark Office, International Preliminary Report on Patentability (Chapter II) dated Jun. 17, 2022 for PCT/US21/32821,.

Vabret, N., et al., "Immunology of COVID-19: Current state of the science," Immunity (2020) 52:910-941.

Van Doremalen, N., et al., "ChAdOx1 nCoV-19 vaccine prevents SARS-CoV-2 pneumonia in rhesus macaques," Nature (2020) 586:578-582.

Verheust, C., et al., "Biosafety aspects of modified vaccinia virus Ankara (MVA)-based vectors used for gene therapy or vaccination," Vaccine (2012) 30:2623-2632.

Vogel, A. B., et al., "BNT162b vaccines protect rhesus macaques from SARS-CoV-2," Nature (2021) 592:283-289.

Volz, A., et al., "Modified vaccinia virus ankara: History, value in basic research, and current perspectives for vaccine development," Adv. Virus Res. (2017) 97:187-243.

Voysey, M., et al., "Safety and efficacy of the ChAdOx1 nCoV-19 vaccine (AZD1222) against SARS-CoV-2: an interim analysis of four randomised controlled trials in Brazil, South Africa, and the UK," Lancet (2021) 397:99-111.

(56)            References Cited

OTHER PUBLICATIONS

Walls, A. C., et al., "Structure, function, and antigenicity of the SARS-CoV-2 spike glycoprotein," Cell (2020) 181:281-292.

Walsh, S. R., et al., "Safety and immunogenicity of modified vaccinia Ankara in hematopoietic stem cell transplant recipients: a randomized, controlled trial," J. Infect. Dis. (2013) 207:1888-1897.

Wang, P., et al., "Antibody resistance of SARS-CoV-2 variants B.1.351 and B.1.1.7," Nature (2021) 593:130-135.

Wang, Z., et al., "Modified H5 promoter improves stability of insert genes while maintaining immunogenicity during extended passage of genetically engineered MVA vaccines," Vaccine (2010) 28:1547-1557.

Wang, Z., et al., "Recombinant modified vaccinia virus Ankara expressing a soluble form of glycoprotein B causes durable immunity and neutralizing antibodies against multiple strains of human cytomegalovirus," J. Virol. (2004) 78:3965-3976.

Wilck, M. B., et al., "Safety and immunogenicity of modified vaccinia Ankara (ACAM3000): effect of dose and route of administration," J. Infect. Dis. (2010) 201:1361-1370.

Wolfl, M., et al., "T-cells in stem cell transplants: dissecting the good, the bad and the ugly," J. Stem Cells Regen. Med. (2007) 2(1):26.

Wolff Sagy, Y., et al., "Real-world effectiveness of a single dose of mpox vaccine in males," Nat. Med. (2023) 29:748-752.

Woolsey, C., et al., "Establishment of an African green monkey model for COVID-19 and protection against re-infection," Nat. Immunol. (2021) 22:86-98.

Wrapp, D., et al., "Cryo-EM structure of the 2019-nCoV spike in the prefusion conformation," Science (2020) 367:1260-1263.

Wussow, F., et al., "A vaccine based on the rhesus cytomegalovirus UL128 complex induces broadly neutralizing antibodies in rhesus macaques," J. Virol. (2013) 87(3):1322-1332.

Wussow, F., et al., "Human cytomegalovirus vaccine based on the envelope gH/gL pentamer complex," PLoS pathogens (2014) 10:e1004524, 23 pages.

Wussow, F., et al., "Exploiting 2A peptides to elicit potent neutralizing antibodies by a multi-subunit herpesvirus glycoprotein complex," J. Virol. Meth. (2018) 251:30-37.

Wussow, F., et al., "COH04S1 and beta sequence-modified vaccine protect hamsters from SARS-CoV-2 variants," iScience (2022) 25:104457.

Wussow, F., et al., "Synthetic multiantigen MVA vaccine COH04S1 and variant-specific derivatives protect Syrian hamsters from SARS-CoV-2 Omicron subvariants," NPJ Vaccines (2023) 8:41, 9 pages.

Wyatt, L. S., et al., "Development of a replication-deficient recombinant vaccinia virus vaccine effective against parainfluenza virus 3 infection in an animal model," Vaccine (1996) 14(15):1451-1458.

Wyatt, L. S., et al., "Highly attenuated smallpox vaccine protects mice with and without immune deficiencies against pathogenic vaccinia virus challenge," Proc. Natl. Acad. Sci. USA (2004) 101(13):4590-4595.

Wyatt, L. S., et al., "Elucidating and minimizing the loss by recombinant vaccinia virus of human immunodeficiency virus gene expression resulting from spontaneous mutations and positive selection," J. Virol. (2009) 83(14):7176-7184.

Yahalom-Ronen, Y., et al., "A single dose of recombinant VSV-deltaG-spike vaccine provides protection against SARS-CoV-2 challenge," Nat. Commun. (2020) 11:6402, 13 pages.

Yu, J., et al., "DNA vaccine protection against SARS-CoV-2 in rhesus macaques," Science (2020) 369:806-811.

Yuan, Y., et al., "Complete regression of cutaneous metastases with systemic immune response in a patient with triple negative breast cancer receiving p53MVA vaccine with pembrolizumab," Oncoimmunology (2017) 6(12):e1363138, 7 pages.

Zaeck, L. M., et al., "Low levels of monkeypox virus neutralizing antibodies after MVA-BN vaccination in healthy individuals," Nat. Med. (2023) 29:270-278.

Zhou, D., et al., "Evidence of escape of SARS-CoV-2 variant B.1.351 from natural and vaccine-induced sera," Cell (2021) 189:2348-2361.

Zhou, P., et al., "A pneumonia outbreak associated with a new coronavirus of probable bat origin," Nature (2020) 579:270-273.

Zhu, F.C., et al., "Safety, tolerability, and immunogenicity of a recombinant adenovirus type-5 vectored COVID-19 vaccine: a dose-escalation, open-label, non-randomised, first-in-human trial," Lancet (2020) 395:1845-1854.

Zhu, N., et al., "A novel coronavirus from patients with pneumonia in China, 2019," New Engl. J. Med. (2020) 382(8):727-733.

Baroudy, B. M., et al., "Incompletely base-paired flip-flop terminal loops link the two DNA strands of the vaccinia virus genome into one uninterrupted polynucleotide chain," Cell 28:315-324 (1982).

Baur, K., et al., "Immediate-early expression of a recombinant antigen by modified vaccinia virus Ankara breaks the immunodominance of strong vector-specific B8R antigen in acute and memory CD8 T-cell responses," J. Virol. 84(17):8743-8752 (2010).

Carvalho, T., et al., "The first 12 months of COVID-19: a timeline of immunological insights," Nat. Rev. Immunol. (2021) 21:245-256.

Cello, et al. "Chemical synthesis of Poliovirus cDNA: Generation of infectious virus in the absence of natural template" Science , Aug. 9, 2002, New Series, vol. 297, No. 5583 (Aug. 9, 2002), 4 pages.

Chung, V., et al., "Evaluation of Safety and Efficacy of p53MVA vaccine combined with Pembrolizumab in patients with advanced solid cancers," Clin. Transl. Oncol. 21(3):363-372 (2019).

Clinicaltrials.gov, NCT04639466, "A synthetic MVA-based SARS-CoV-2 vaccine, GEO-CM04S1, for the prevention of COVID-19 infection," Sponsored: GeoVax, Inc. First submitted Nov. 4, 2020, accessed on Jul. 7, 2025 atClinicalTrials.gov.

Cochran, M. A., et al., "In vitro mutagenesis of the promoter region for a vaccinia virus gene: Evidence for tandem early and late regulatory signals," J. Virol. 54(1):30-37 (1985).

Czar, et al. "Gene synthesis demystified" Trends in Biotechnology vol. 27 No.2, 10 pages.

Delange, A. M., et al., "Sequence-nonspecific replication of transfected plasmid DNA in poxvirus-infected cells," Proc. Natl. Acad. Sci. USA 83:614-618 (1986).

Diamond, D. J., et al., "A Fifty-Year Odyssey: Prospects for a Cytomegalovirus Vaccine in Transplant and Congenital Infection," Expert Rev. Vaccines 17(10):889-911 (2018).

Domi, A., et al., "Engineering of a vaccinia virus bacterial artificial chromosome in *Escherichia coli* by bacteriophage I-based recombination," Nat. Meth. (2005) 2(2):95-97.

Draper, S. J., et al., "Utilizing Poxviral Vectored Vaccines for Antibody Induction—Progress and Prospects," Vaccine 31:4223-4230 (2013).

Espenschied, J., et al., "CTLA-4 Blockade Enhances the Therapeutic Effect of an Attenuated Poxvirus Vaccine Targeting p53 in an Established Murine Turmor Model," J. Immunol. 170(6):3401-3407 (2003).

European Patent Office, Extended European Search Report and Opinion dated May 15, 2024 for European Patent Application No. 21750239.2, 8 pages.

Garcia, A. D., et al., "Repression of Vaccinia Virus Holliday Junction Resolvase Inhibits Processing of Viral DNA into Unit-Length Genomes," J. Virol. 75(14):6460-6471 (2001).

"Garcia-Arriaza, J., et al., "Deletion of the Vaccinia Virus N2L Gene Encoding an Inhibitor of IRF3 Improves the Immunogenicity of Modified Vaccinia Virus Ankara Expressing HIV-1 Antigens," J. Virol. 88(6):3392-3410 (2014)."

Geshelin, P., et al., "Characterization and Localization of the Naturally Occurring Cross-Links in Vaccinia Virus DNA," J. Mol. Biol. 88:785-796 (1974).

Greenberg, R. N., et al., "A Multicenter, Open-Label, Controlled Phase II Study to Evaluate Safety and Immunogenicity of MVA Smallpox Vaccine (IMVAMUNE) in 18-40 Year Old Subjects with Diagnosed Atopic Dermatitis," PLoS One 10(10):e0138348 (2015).

Ishizaki, H., et al., "Modified Vaccinia Ankara Expressing Survivin Combined with Gemcitabine Generates Specific Antitumor Effects in a Murine Pancreatic Carcinoma Model," Cancer Immunol. Immunother. 60(1):99-109 (2011).

Kugler, F., et al., "Generation of recombinant MVA-norovirus: a comparison study of bacterial artificial chromosome- and marker-based systems," Virol. J. (2019) 16:100, 12 pages.

(56)                    References Cited

OTHER PUBLICATIONS

Li, J.D., et al., "Construction of universal transfer vector used in goat pox virus recombination," Chin. J. Vet. Sci. (2016) 36(12):2042-2048.

"Max-Planck-Gesellschaft, ""Impetus for a corona vaccine,"" May 3, 2020, pp. 1-5, [retrieved on Jul. 25, 2025], Internet: <URL: https://www.mpg.de/14773435/corona-covid19-vaccine-production>".

Mayr, A., et al., "[The Smallpox Vaccination Strain MVA: Marker, Genetic Structure, Experience Gained with Theparenteral Vaccination and Behavior in Organisms with a Debilitated Defence Mechanism (author's translation)]," article in German with English abstract, Zentralbl Bakteriol B. 167(5-6):375-90 (1978).

McFadden, G., "Poxvirus Tropism," Nat. Rev. Microbiol. 3:201-213 (2005).

Merchlinsky, M., et al., "Resolution of Vaccinia Virus DNA Concatemer Junctions Requires Late-Gene Expression," J. Virol. 63(4):1595-1603 (1989).

Meyer, H., et al., "Mapping of Deletions in the Genome of the Highly Attenuated Vaccinia Virus MVA and Their Influence on Virulence," J. Gen. Virol. 72:1031-1038 (1991).

Moyer, R. W., et al., "The Mechanism of Cytoplasmic Orthopoxvirus DNA Replication," Cell 27:391-401 (1981).

Nakanishi, H., et al., "Comparison of piggyBac transposition efficiency between linear and circular donor vectors in mammalian cells," J. Biotechnol. (2011) 154:205-208.

Schmelz, M., et al., "Assembly of Vaccinia Virus: the Second Wrapping Cisterna is Derived from the Trans Golgi Network," J. Virol. 68(1):130-147 (1994).

Tripp, R. A., et al., "Monoclonal antibodies to SARS-associated coronavirus (SARS-CoV): Identification of neutralizing and antibodies reactive to S, N, M and E viral proteins," J. Virol. Meth. (2005) 128:21-28.

Tumpey, et al. "Characterization of the Reconstructed 1918 Spanish Influenza Pandemic Virus" Science , Oct. 7, 2005, New Series, vol. 310, No. 5745 (Oct. 7, 2005), 5 pages.

United States Patent and Trademark Office, International Search Report and Written Opinion dated May 20, 2021 for PCT/US21/16247, 11 pages.

Vollmar, J., et al., "Safety and Immunogenicity of IMVAMUNE, a Promising Candidate as a Third Generation Smallpox Vaccine," Vaccine 24:2065-2070 (2006).

Yao, et al. "High-Frequency Genetic Recombination and Reactivation of Orthopoxviruses from DNA Fragments Transfected into Leporipoxvirus-Infected Cells" Journal of Virology, Jul. 2003, vol. 77, No. 13, 10 pages.

Zhang, et al., "*Betacoronavirus* sp. Isolate Wuhan-Hu-1, complete genome," GenBank accession No. MN908947.1 (2020), 11 pages.

* cited by examiner

Fig. 1A
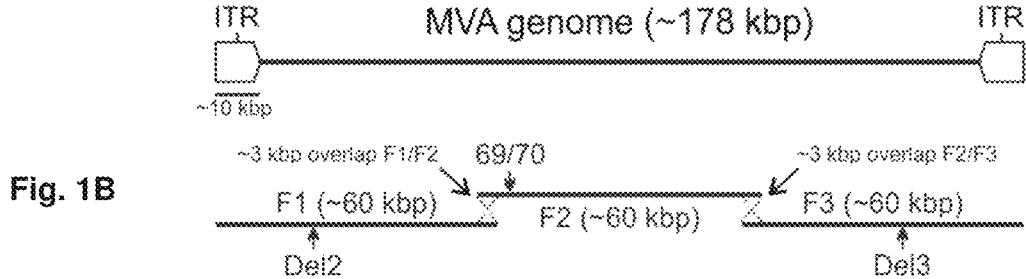
Fig. 1B
Fig. 1C
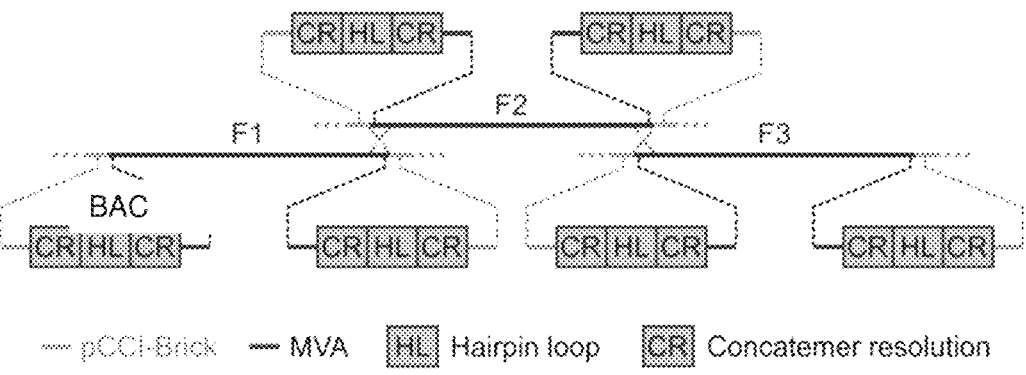

Fig. 2A
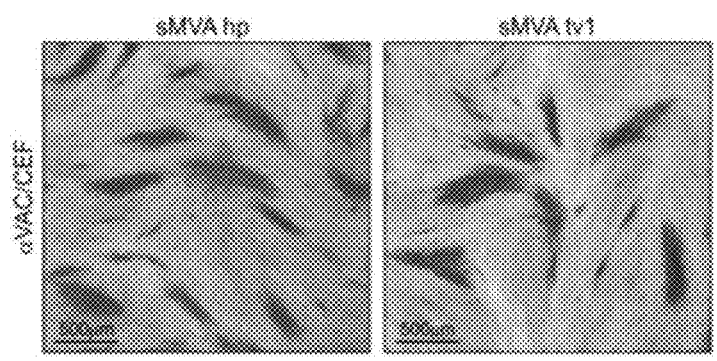
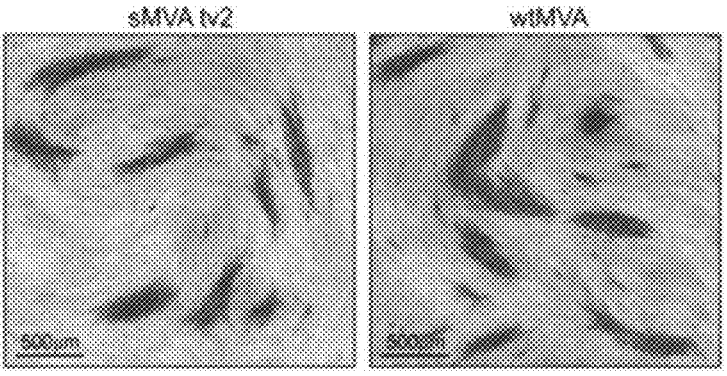
Fig. 2B
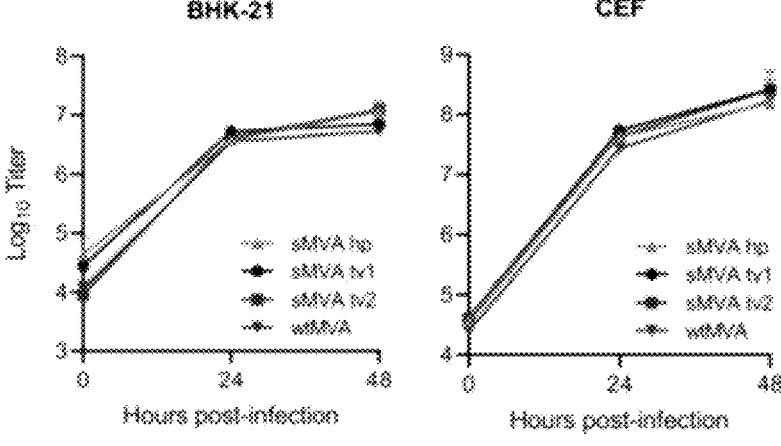

Fig. 3A
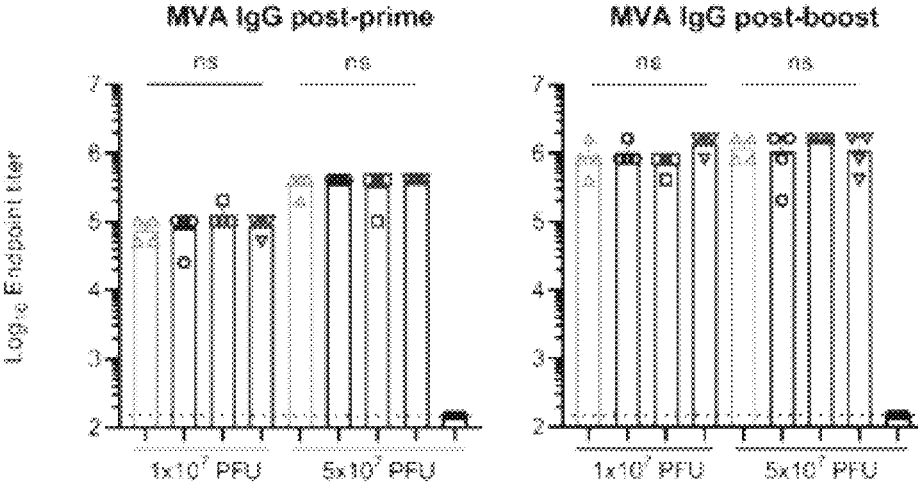
Fig. 3B
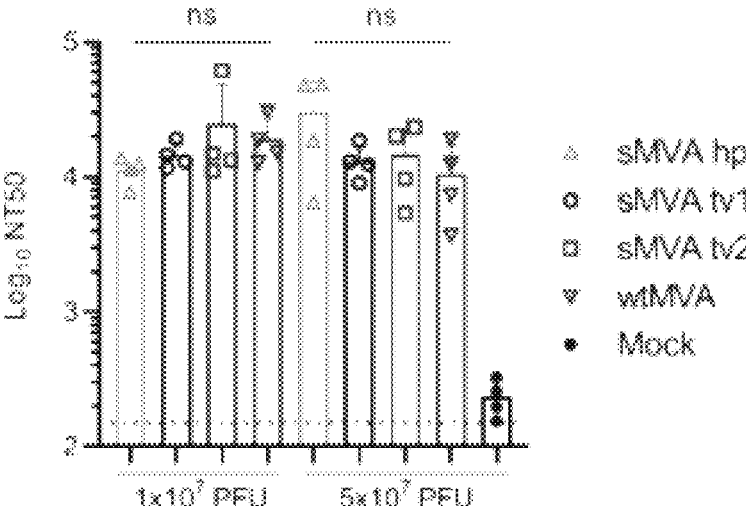

Fig. 3C
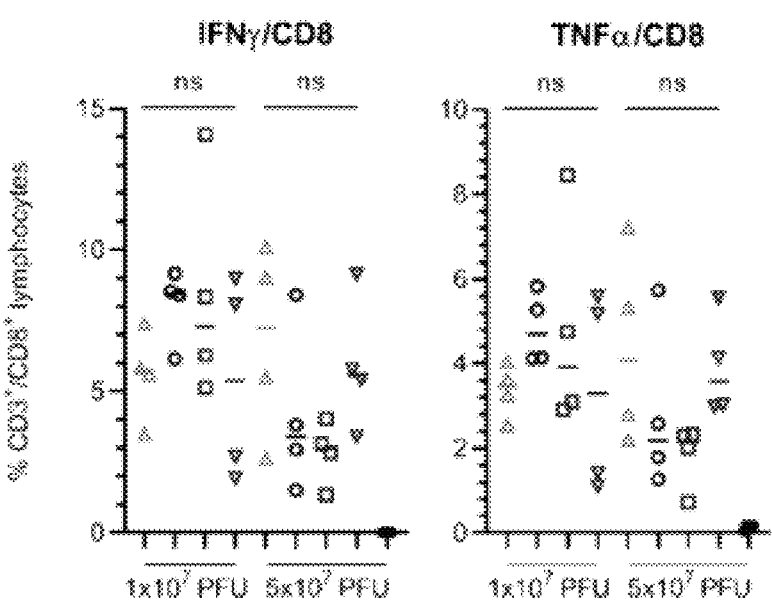
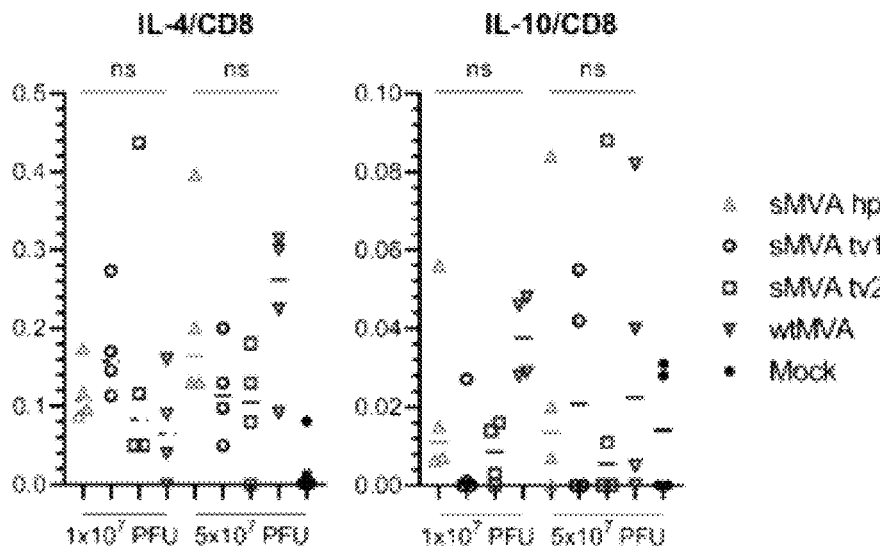

Fig. 3D
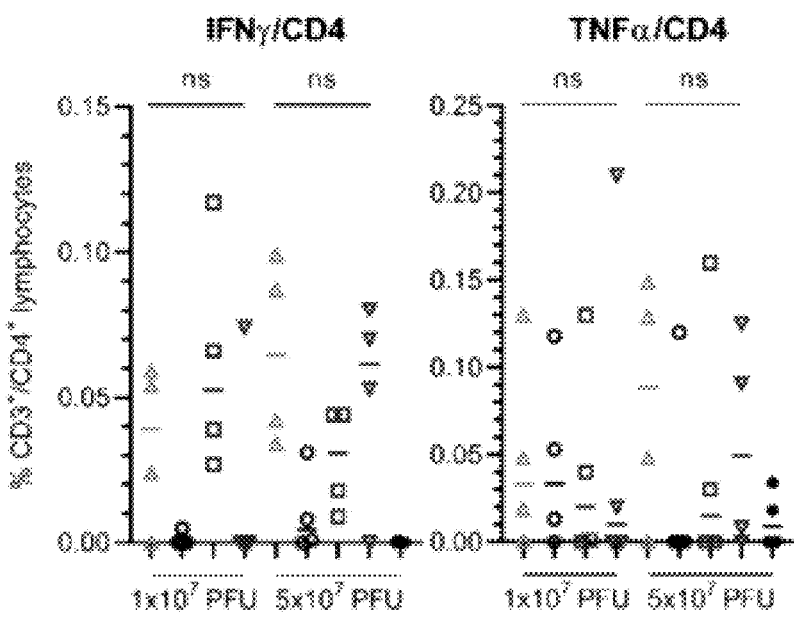
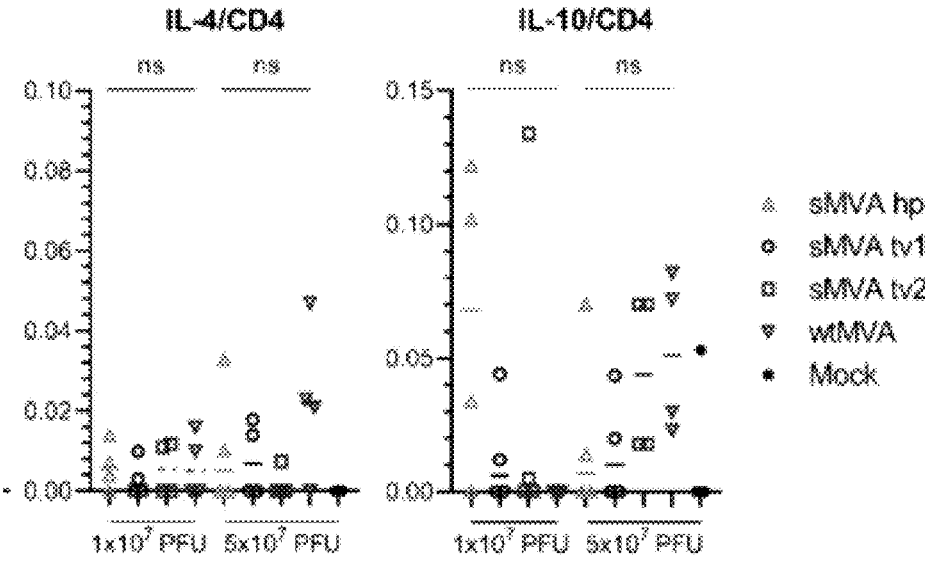

Fig. 4D
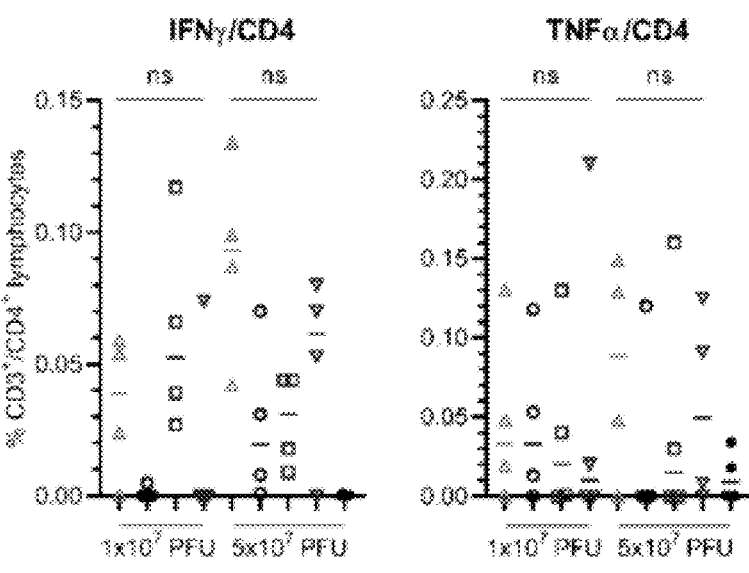
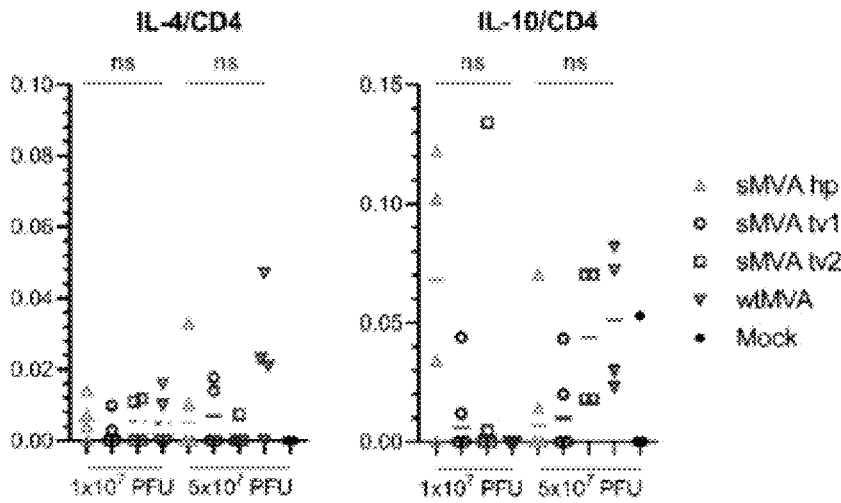

| | |
|---|---|
| O | sMVA-S/N hp |
| ▽ | sMVA-N/S hp |
| ◇ | sMVA-S/N tv |
| △ | sMVA-N/S tv |
| O | sMVA-S tv |
| □ | sMVA-N tv |
| ▽ | sMVA tv |
| ▲ | Mock |

Fig. 9A
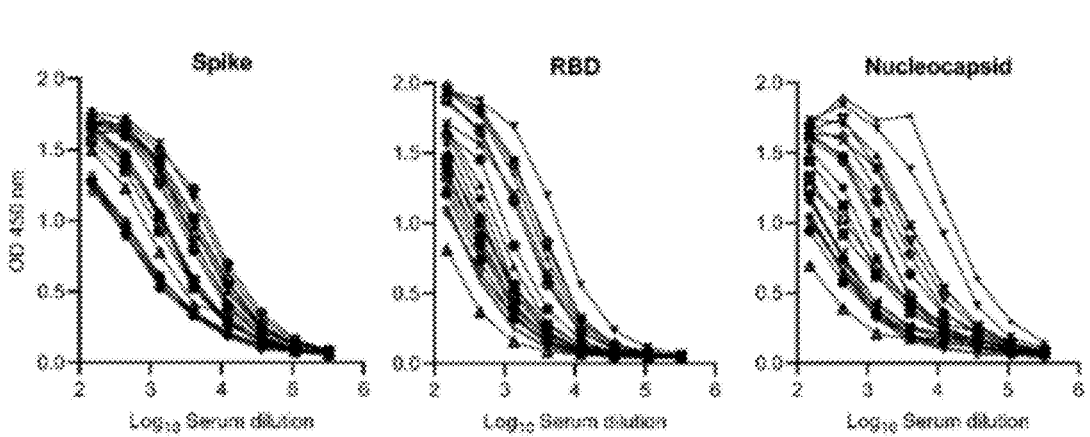
Fig. 9B
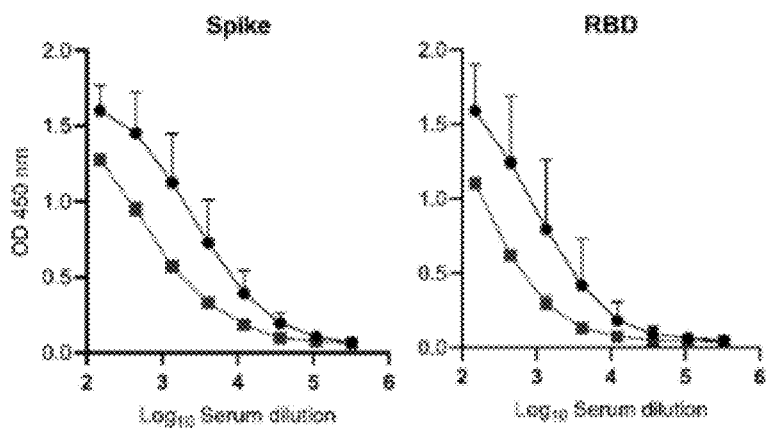
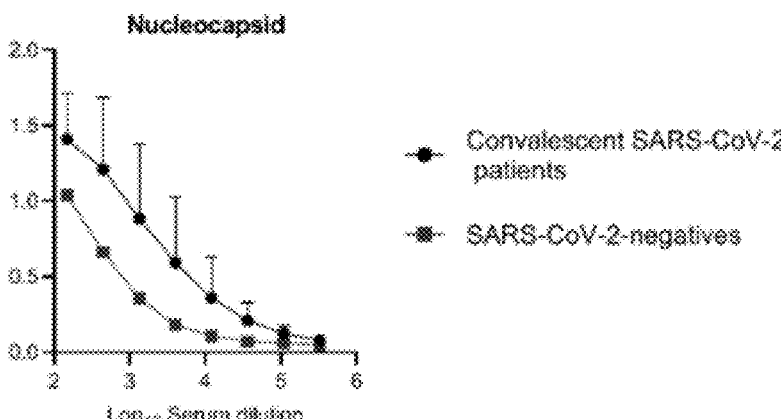

Fig. 10B
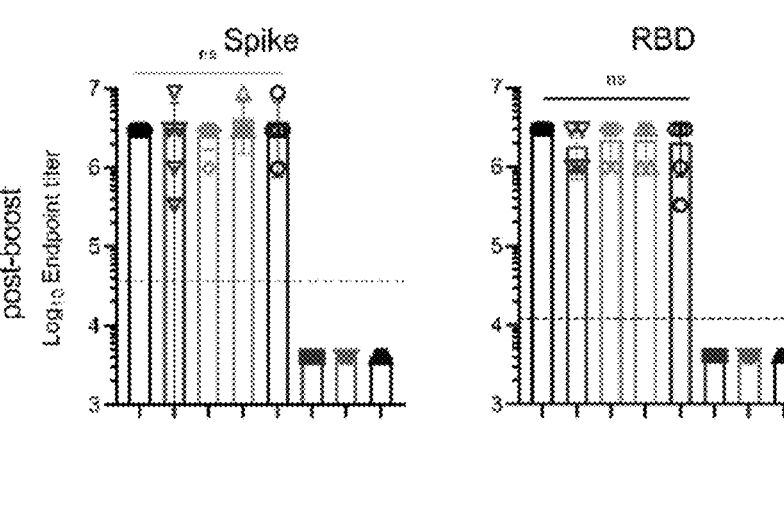
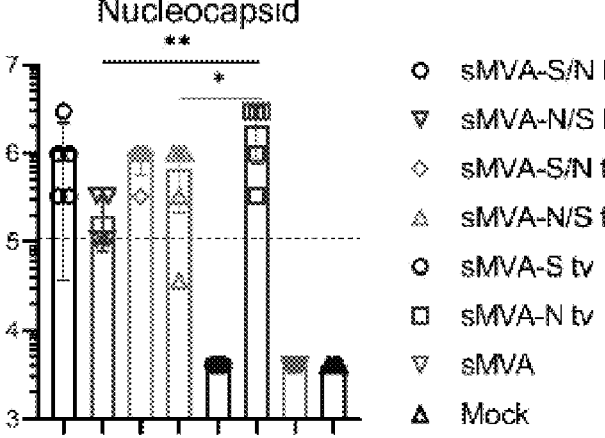
| | |
|---|---|
| ○ | sMVA-S/N hp |
| ▽ | sMVA-N/S hp |
| ◇ | sMVA-S/N tv |
| △ | sMVA-N/S tv |
| ○ | sMVA-S tv |
| □ | sMVA-N tv |
| ▽ | sMVA |
| △ | Mock |

Fig. 11
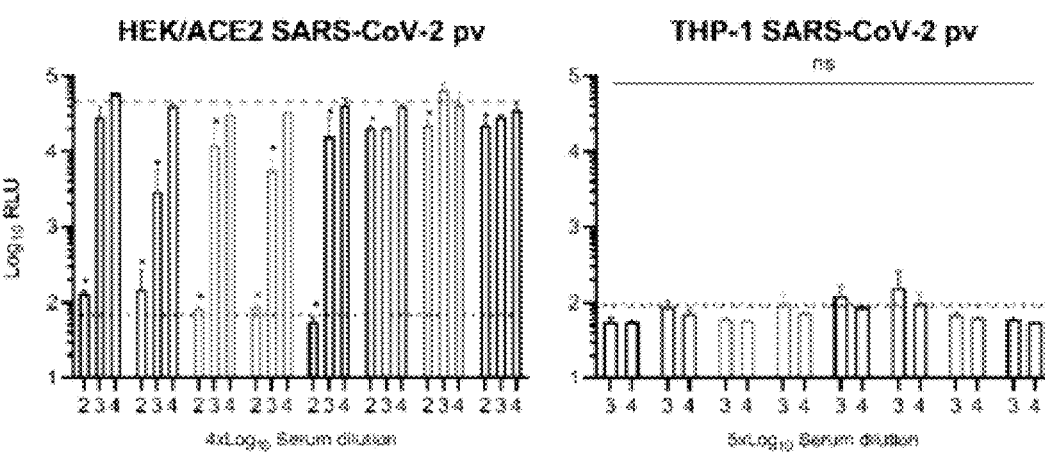
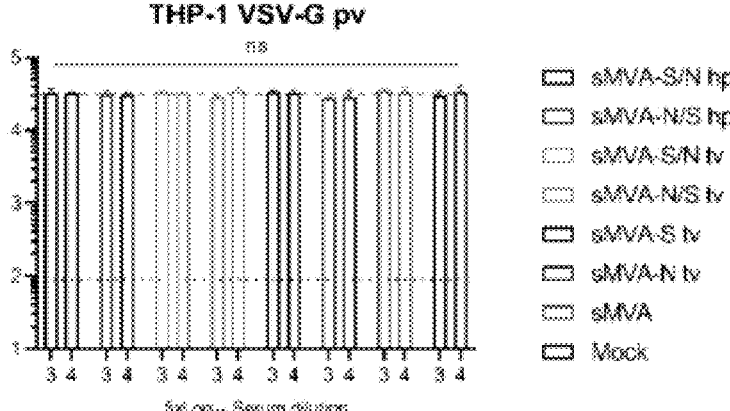

Fig. 12A
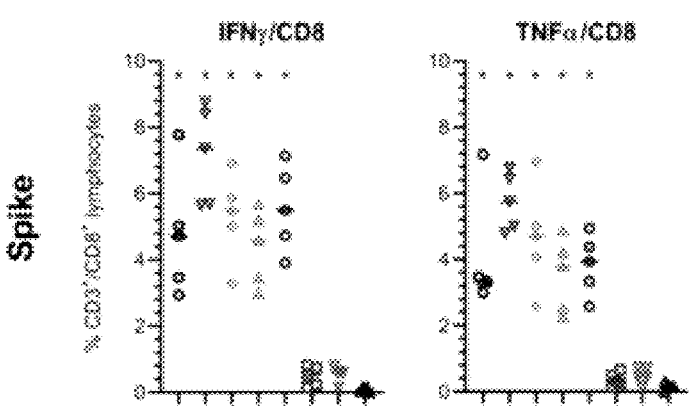
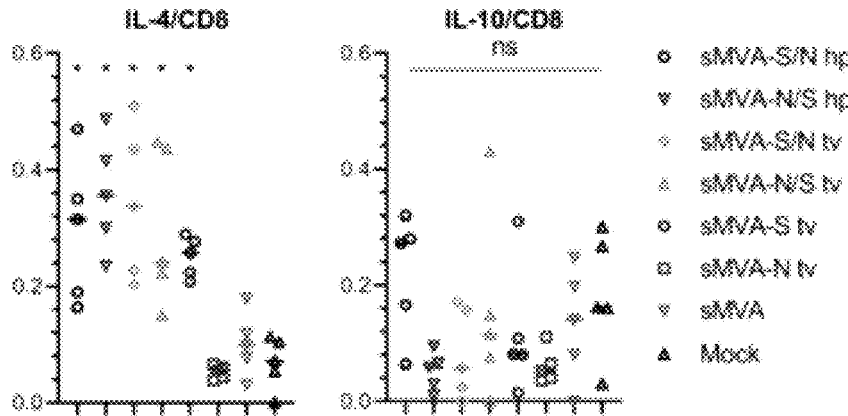

Fig. 12B
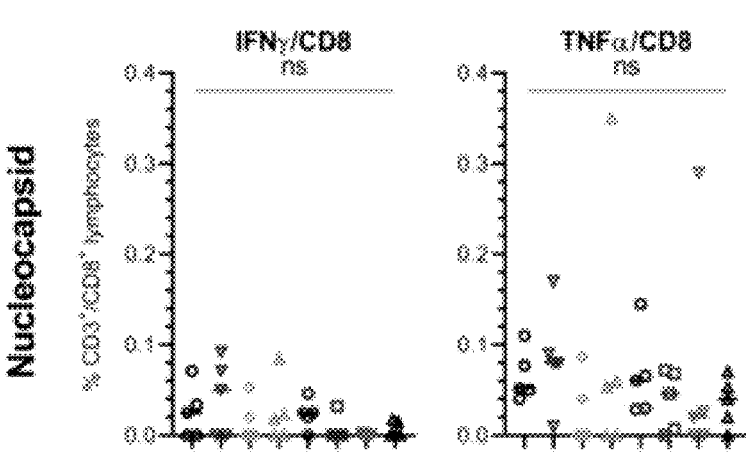
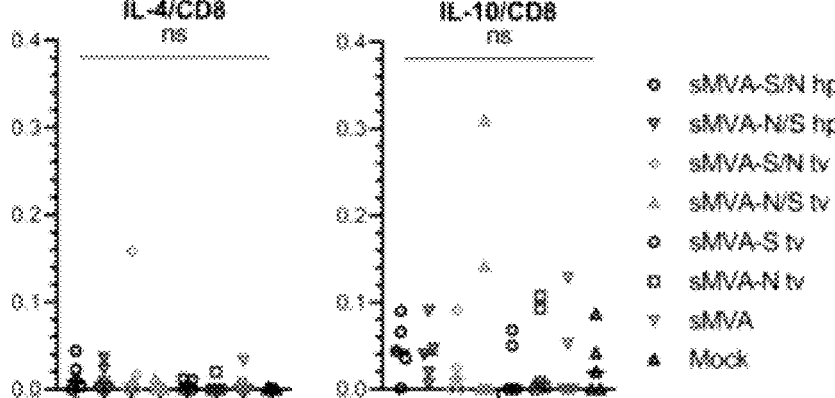

Fig. 12C
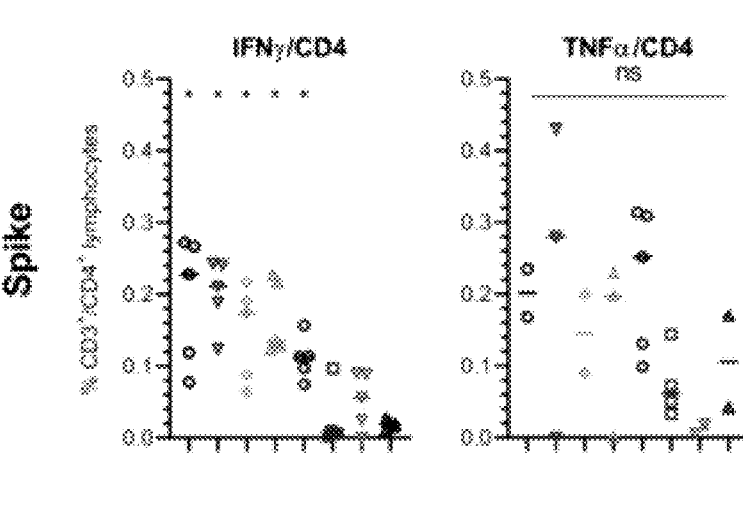
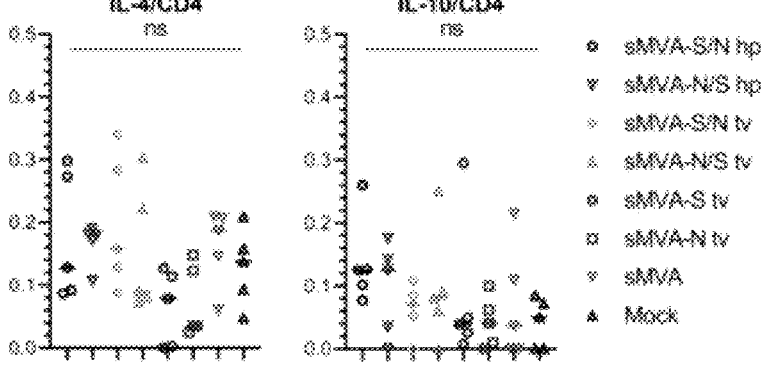

Fig. 12D
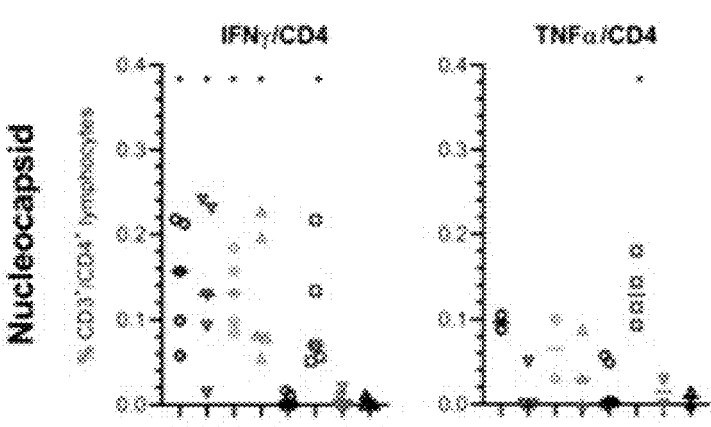
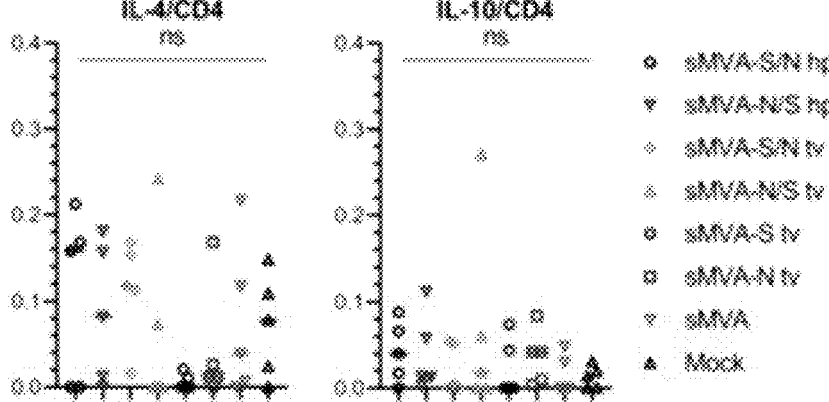

Fig. 14
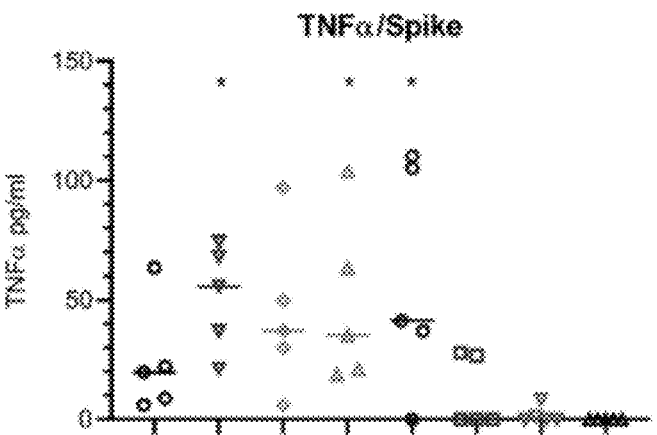
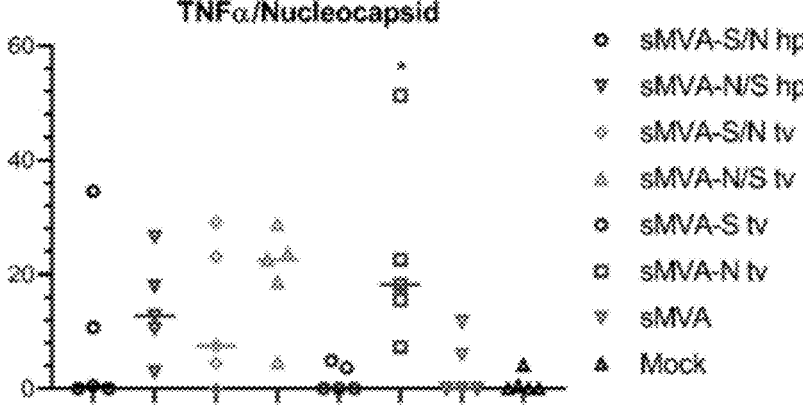

Fig. 15A
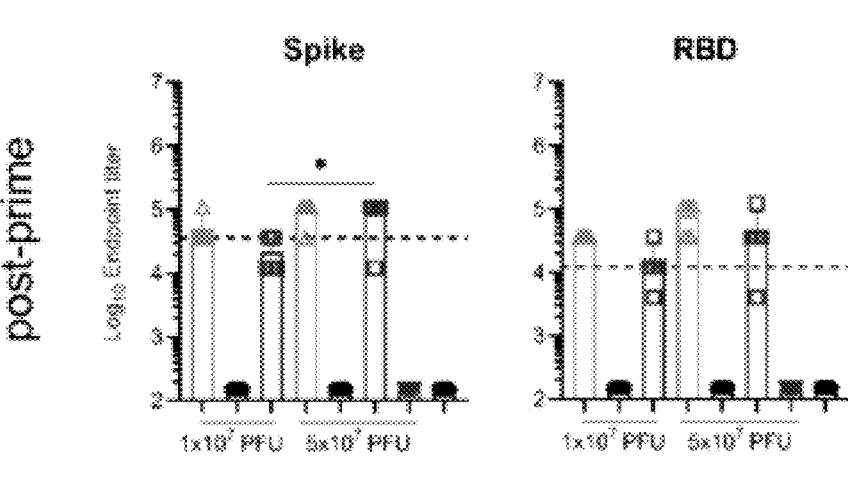
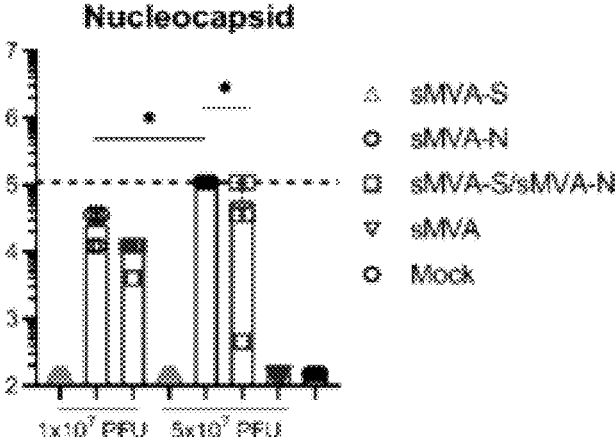

Fig. 15C
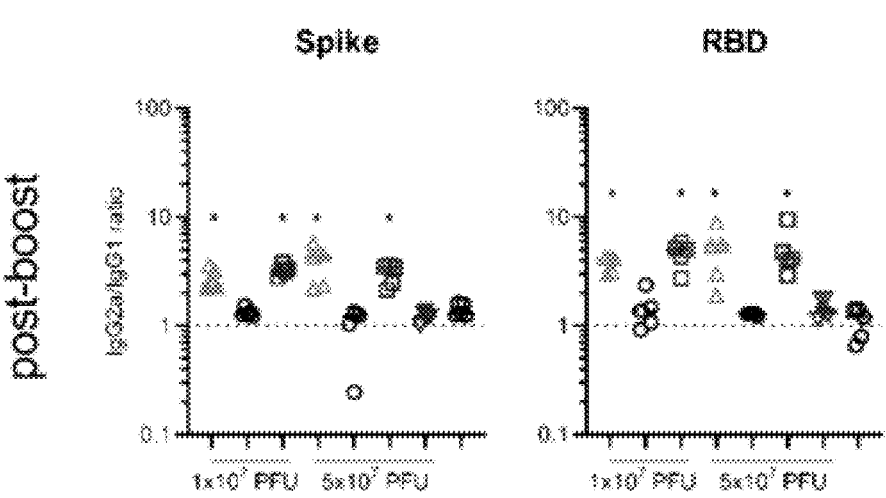
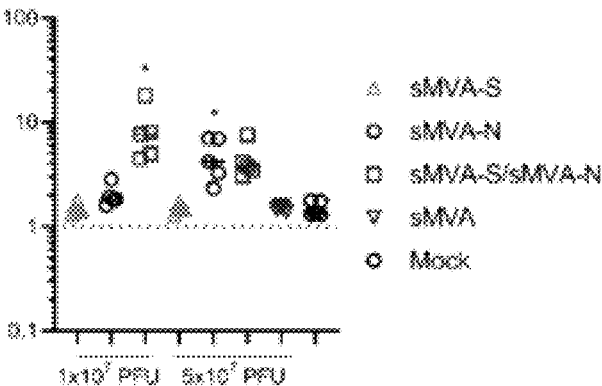

Fig. 16B
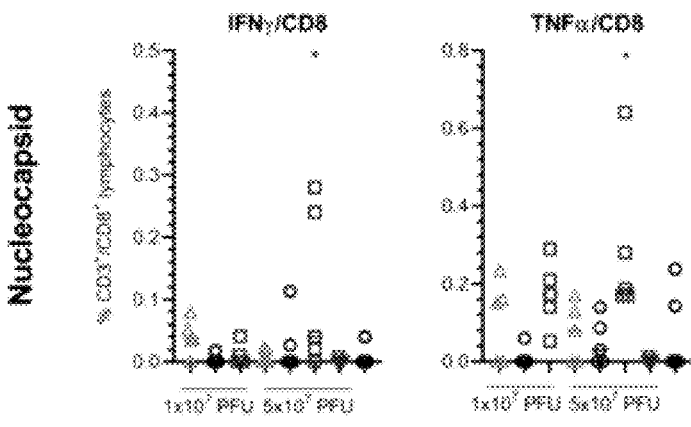
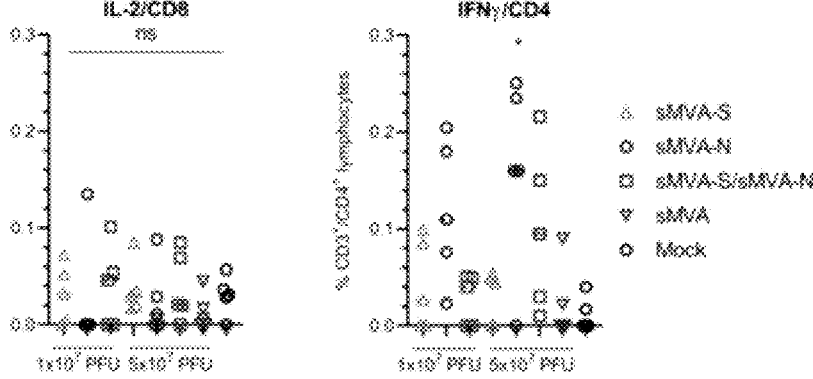

Fig. 19
Antigen-specific CD4+ T cell responses
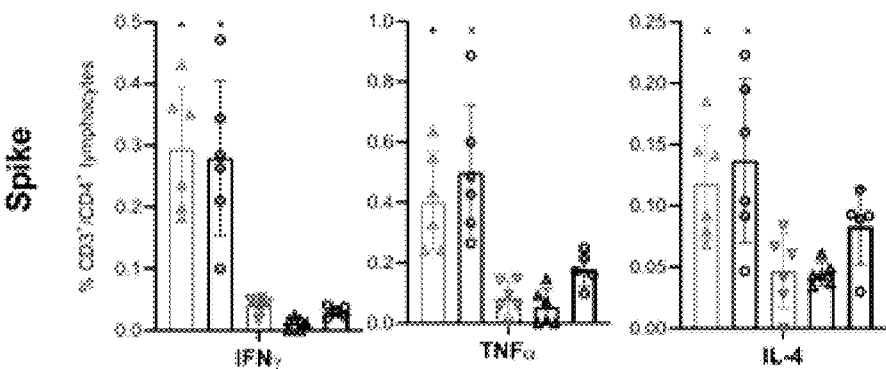
Antigen-specific CD8+ T cell responses
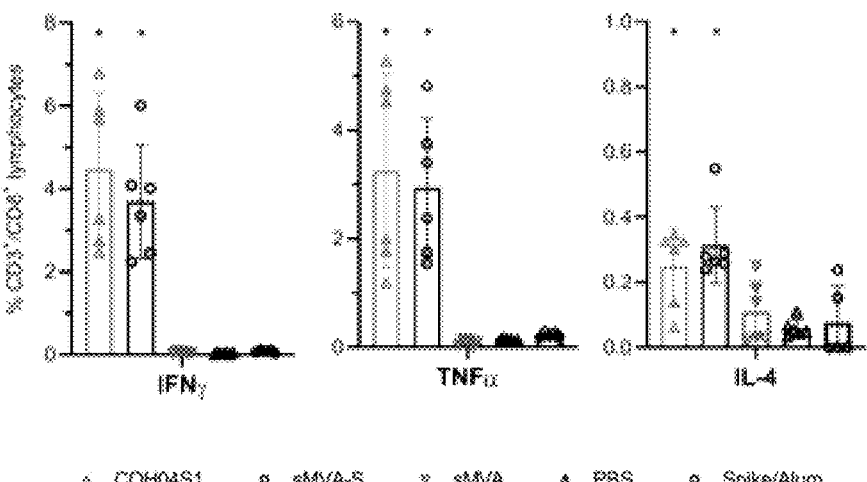

Fig. 20
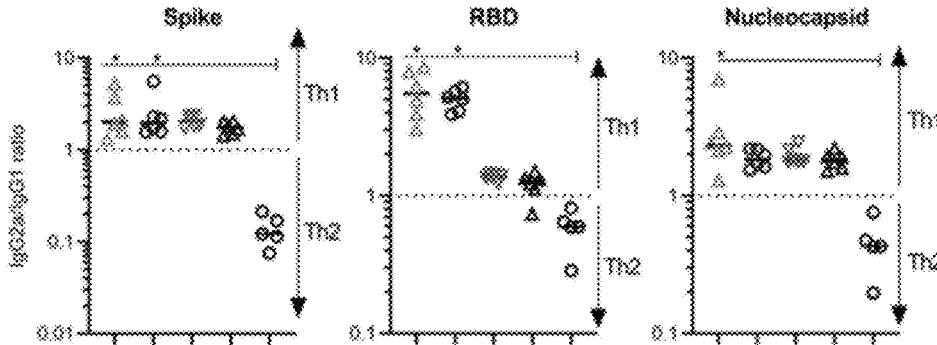
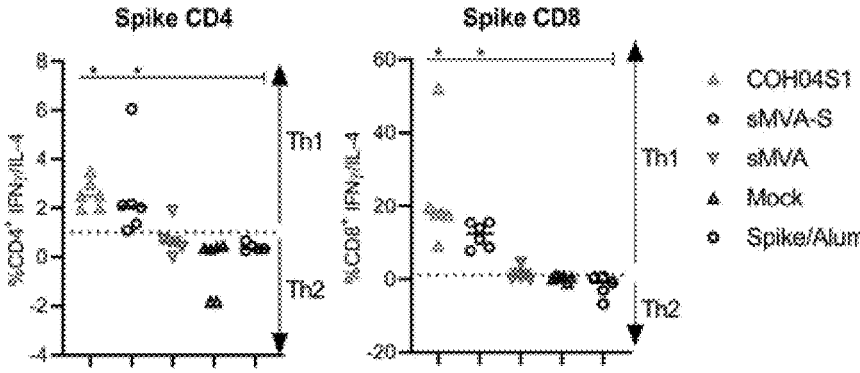

SARS-CoV-2/VeroE6

Fig. 23
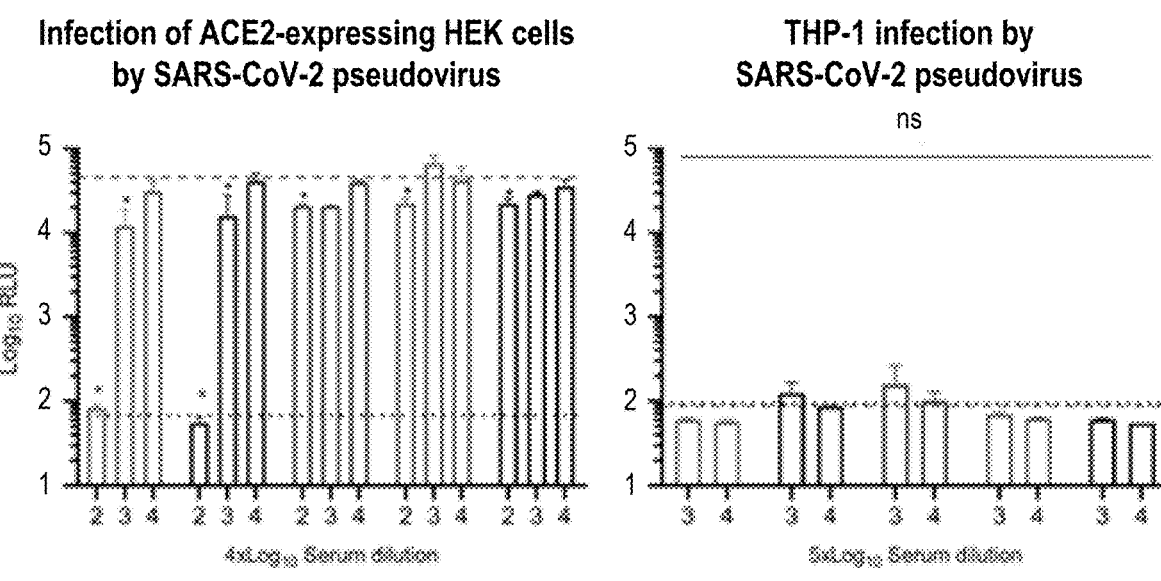
Infection of ACE2-expressing HEK cells
by SARS-CoV-2 pseudovirus
THP-1 infection by
SARS-CoV-2 pseudovirus
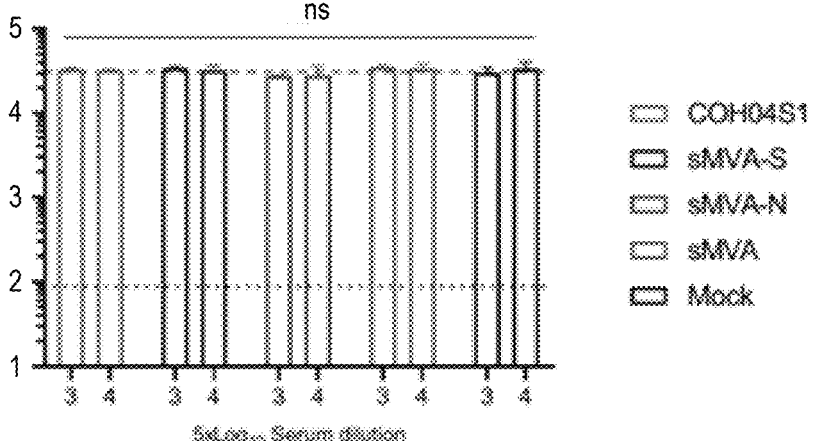
THP-1 infection by VSV virus (which does
not express the SARS-CoV-2 antigen)

Fig. 24
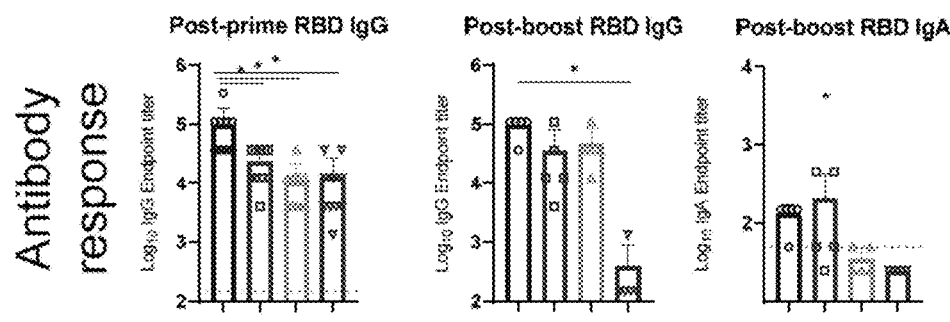
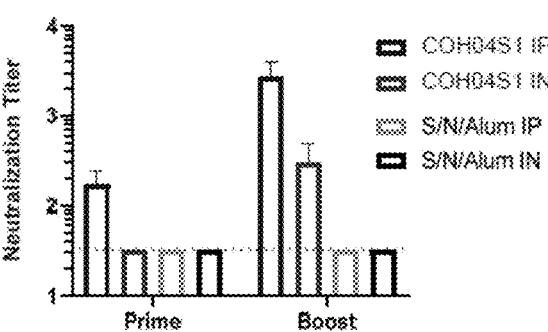
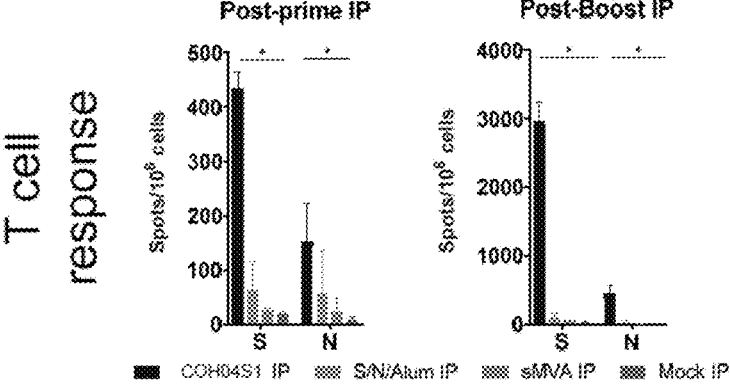
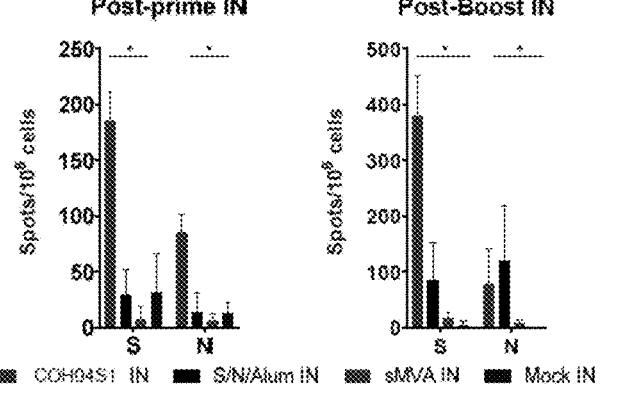

Fig. 25C      Fig. 25D

Fig. 27
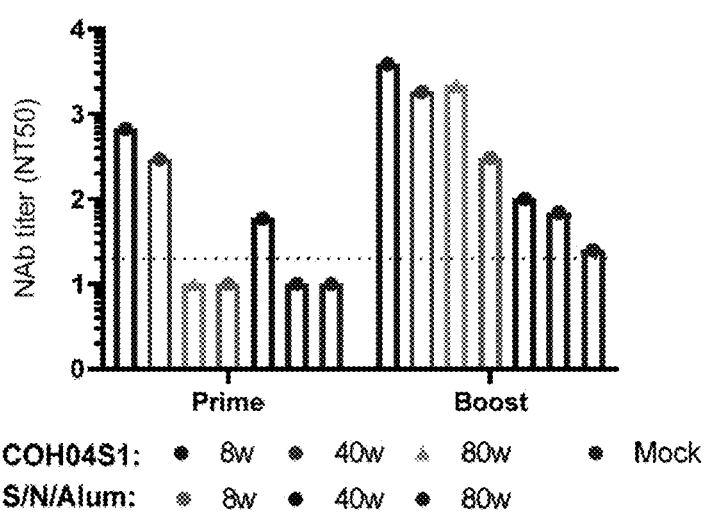
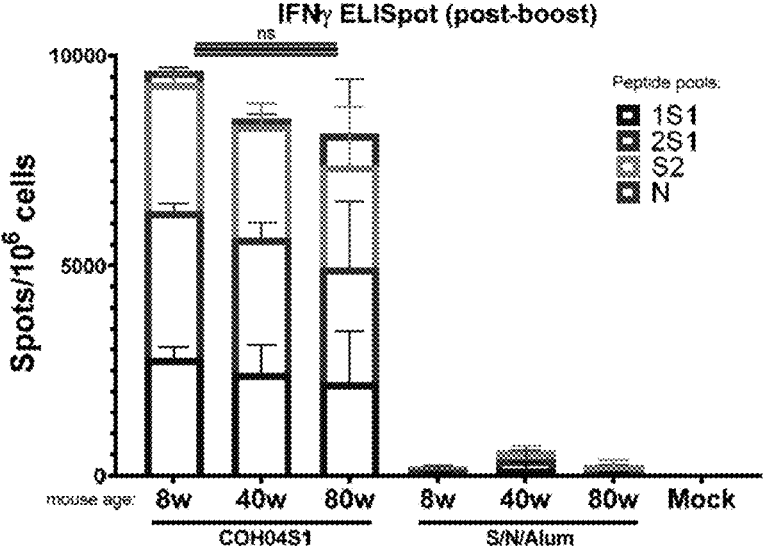

Fig. 28
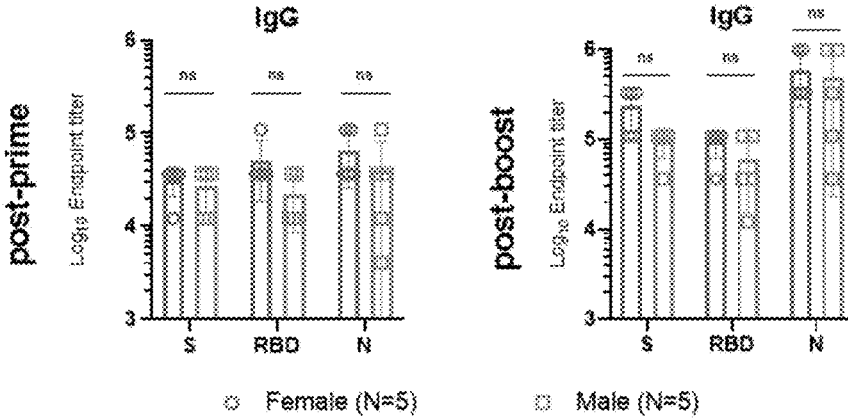
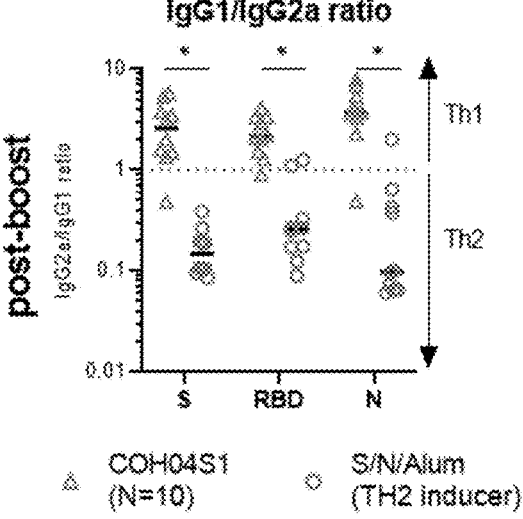

Fig. 29

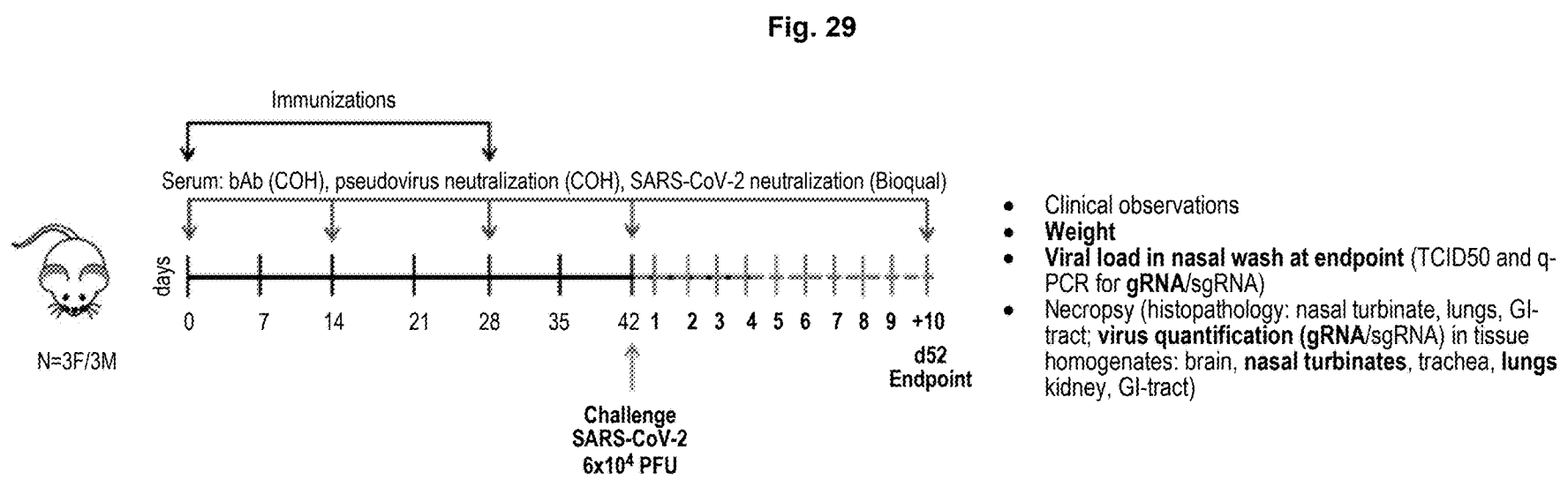

- Clinical observations
- Weight
- Viral load in nasal wash at endpoint (TCID50 and q-PCR for gRNA/sgRNA)
- Necropsy (histopathology: nasal turbinate, lungs, GI-tract; virus quantification (gRNA/sgRNA) in tissue homogenates: brain, nasal turbinates, trachea, lungs kidney, GI-tract)

Serum: bAb (COH), pseudovirus neutralization (COH), SARS-CoV-2 neutralization (Bioqual)

Immunizations days  0   7   14   21   28   35   42 1 2 3 4 5 6 7 8 9 +10 d52
Endpoint

Challenge
SARS-CoV-2
6x10⁴ PFU

N=3F/3M

Fig. 30
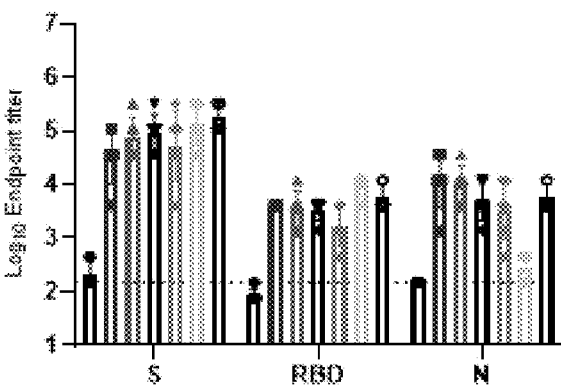
Endpoint titers d28 IM
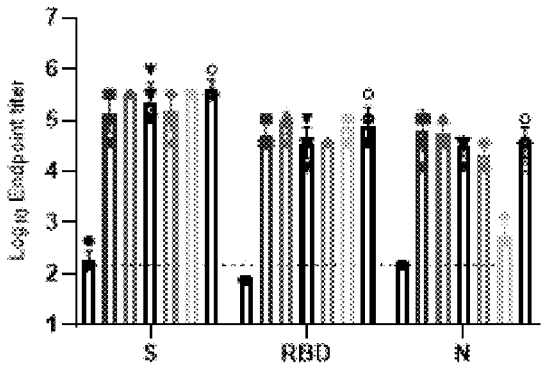
Endpoint titers d42 IM
- ● sMVA-IM
- ✸ S2P/N (C79)-IM
- ▲ COH04S1 (C35/F4/B1)-IM
- ▼ S/N (C35/F4/D5)-IM
- ◇ S/N (C46/C3/F10)-IM
- ◦ S (C15)-IM
- ○ S/N (C35)-IM Fig. 30 (cont'd)
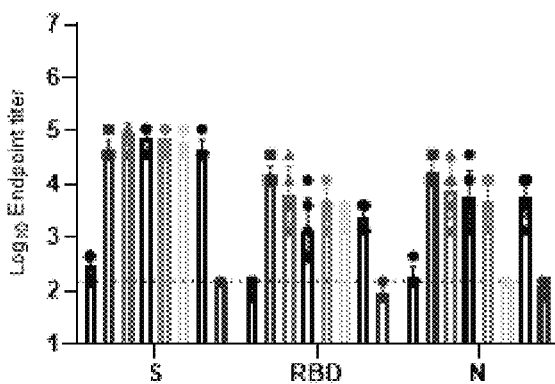
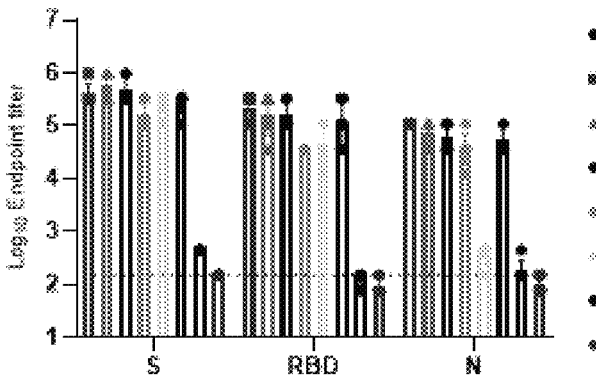

Fig. 31
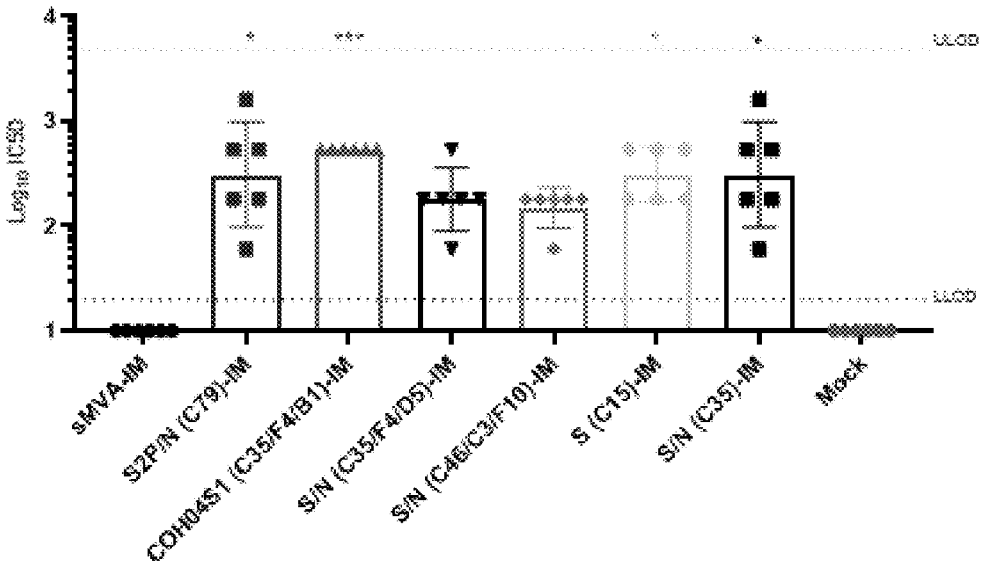
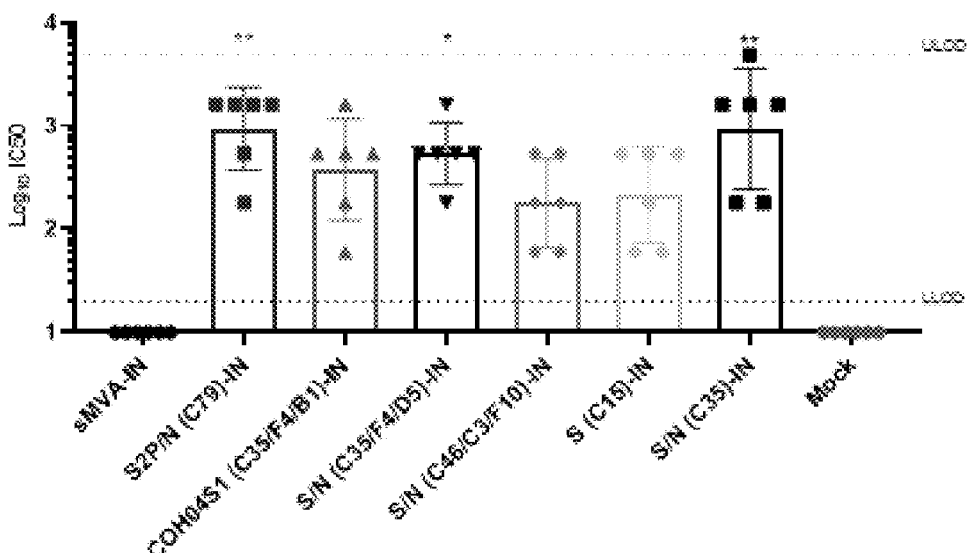

Fig. 34

Post-prime (d28)

Post-boost (d42)

Fig. 34 (cont'd)
IgG2-3/IgG1 ratio
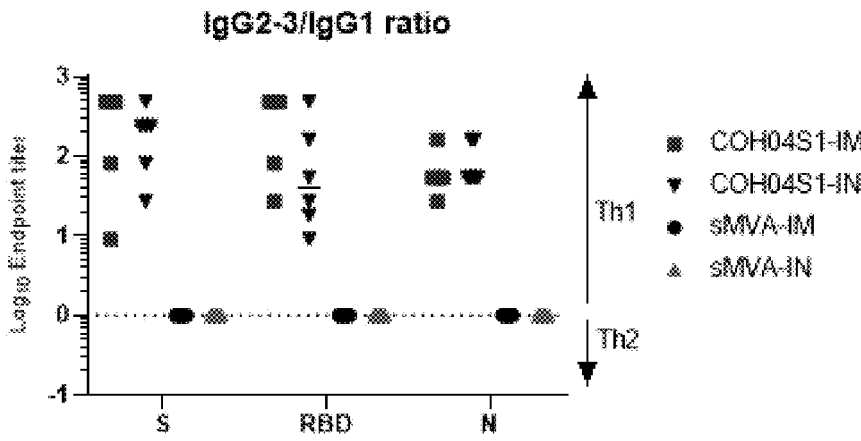
Day 42 Neutralizing titer
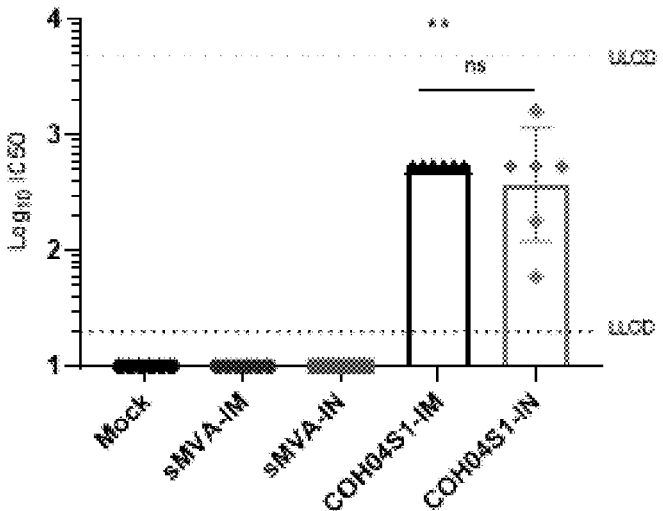

Fig. 35
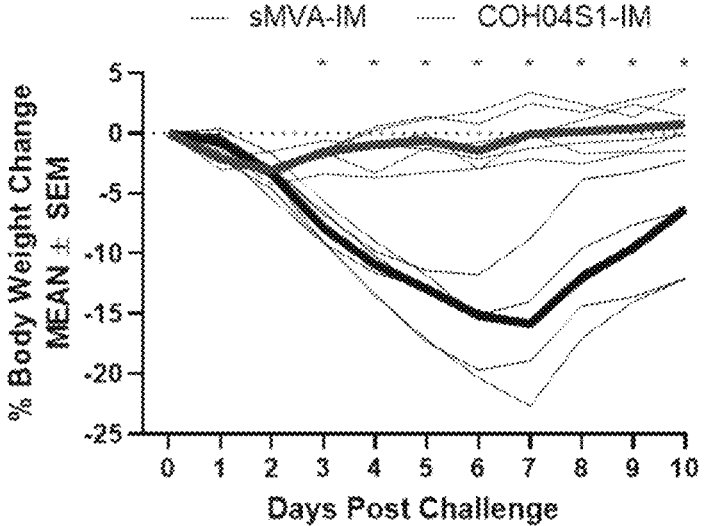
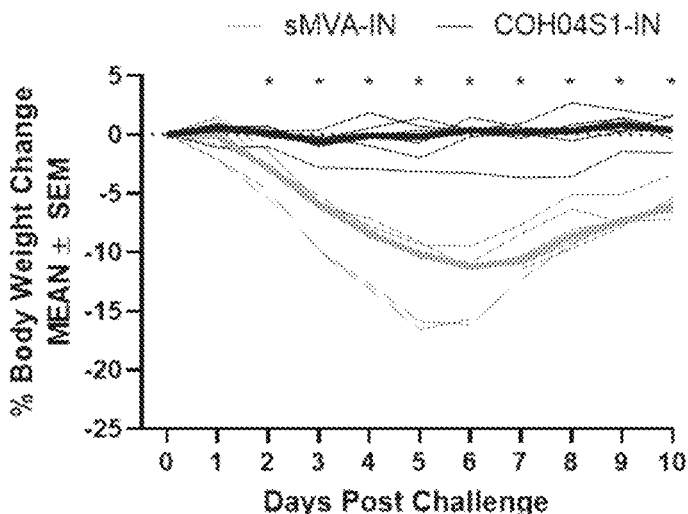

Fig. 37
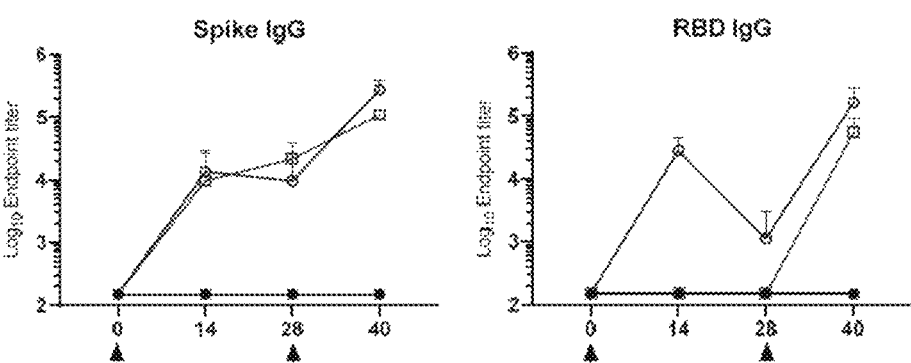
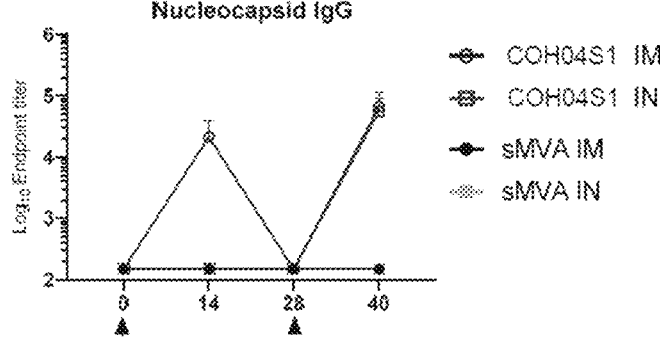
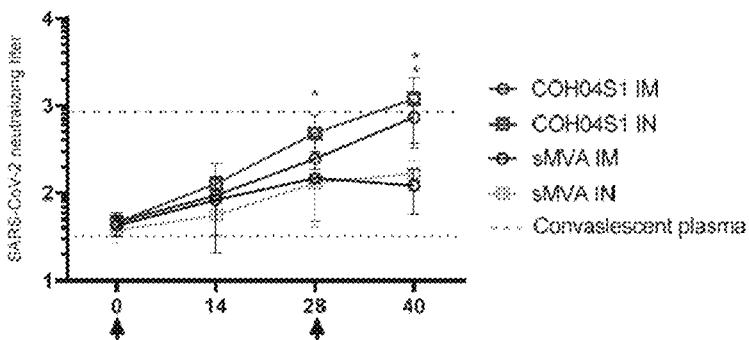
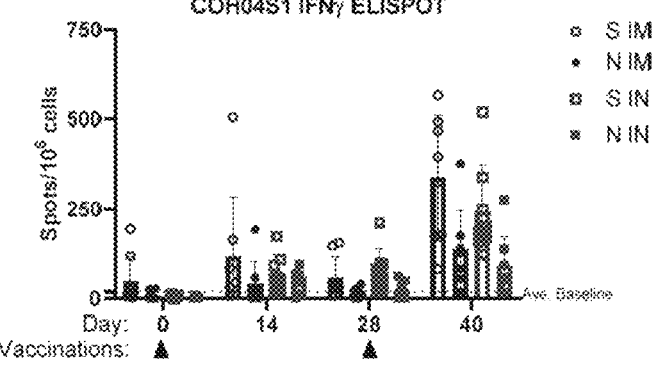

Fig. 39
Prime-boost
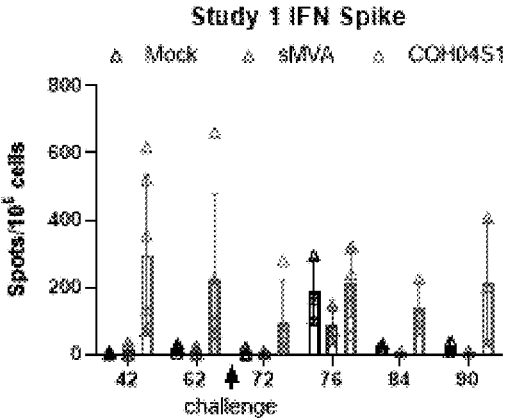
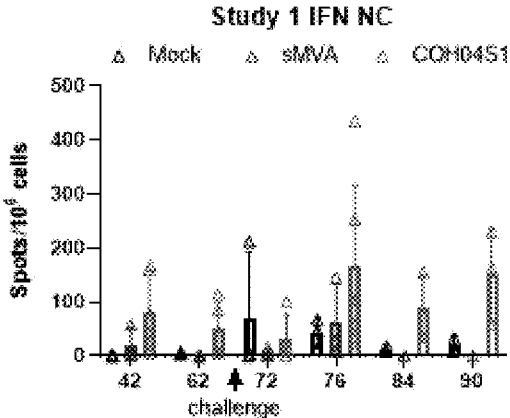
Prime-only
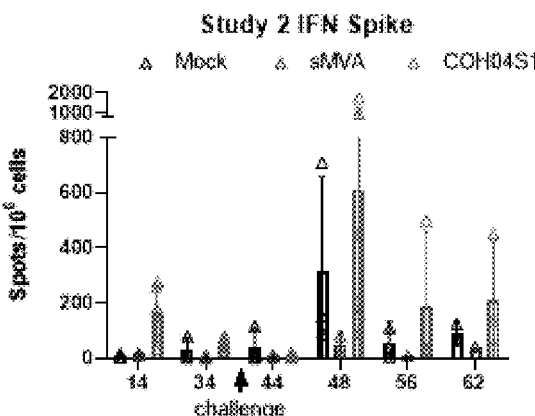
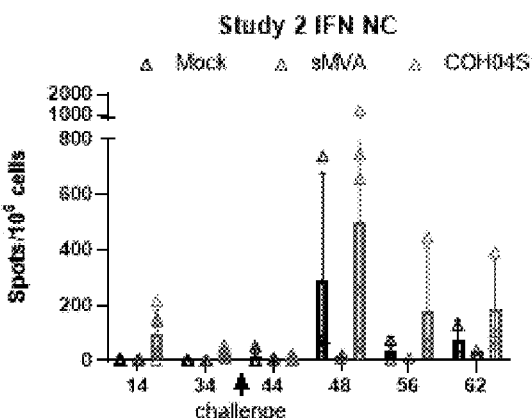

Fig. 40
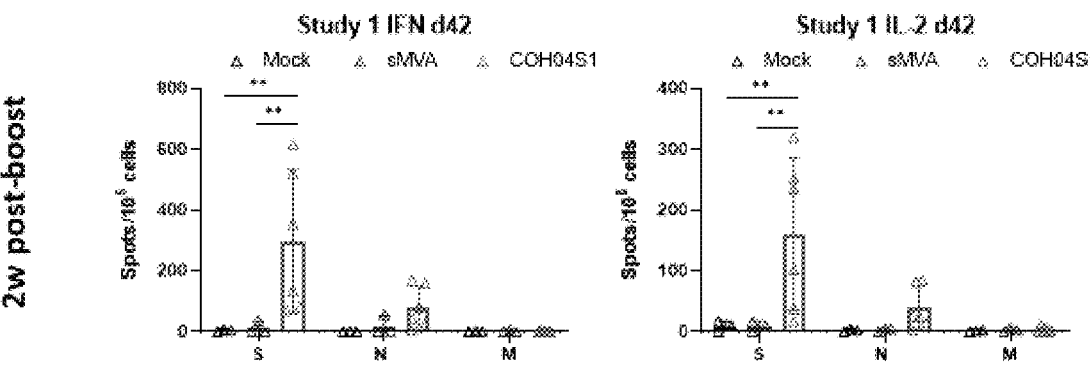
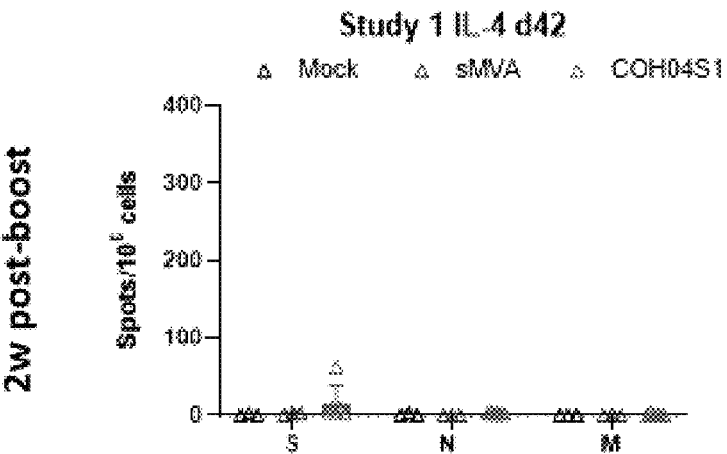

Fig. 40 (cont'd)
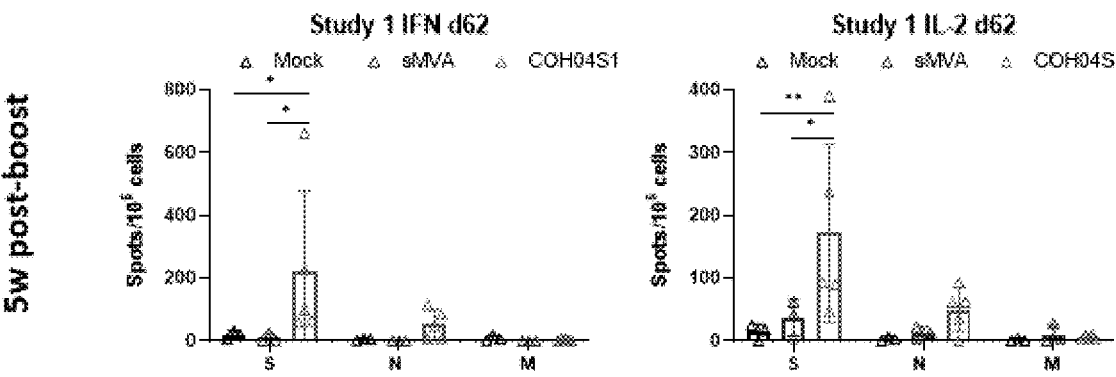
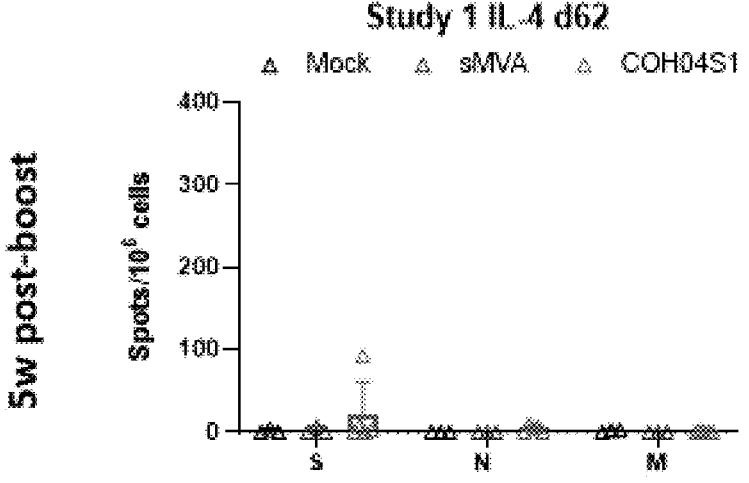

Fig. 41
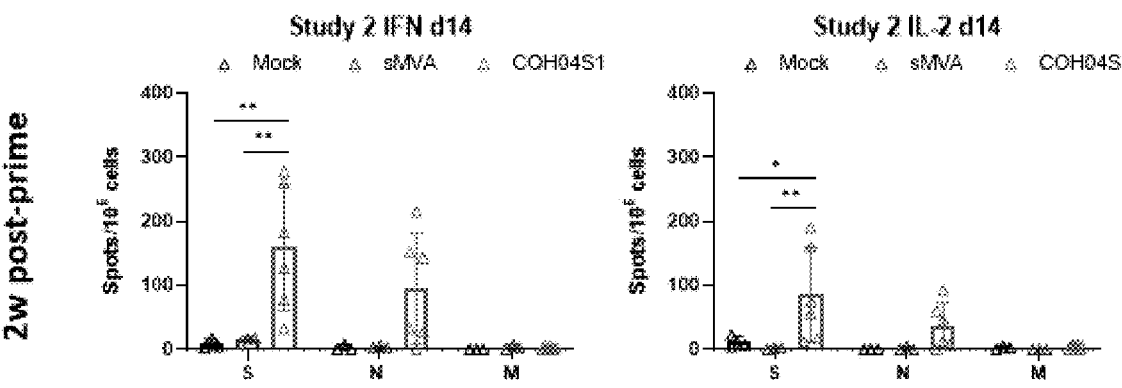
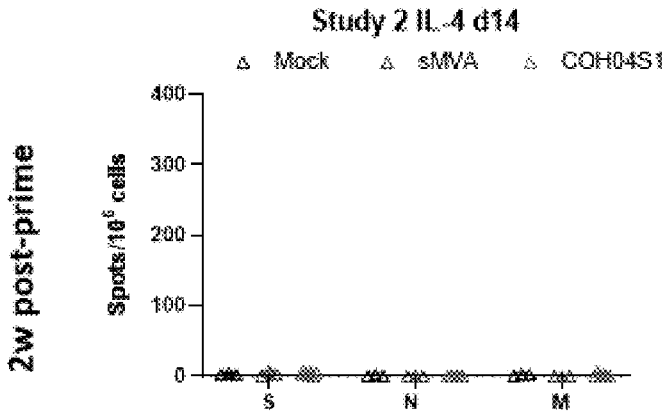

Fig. 41 (cont'd)
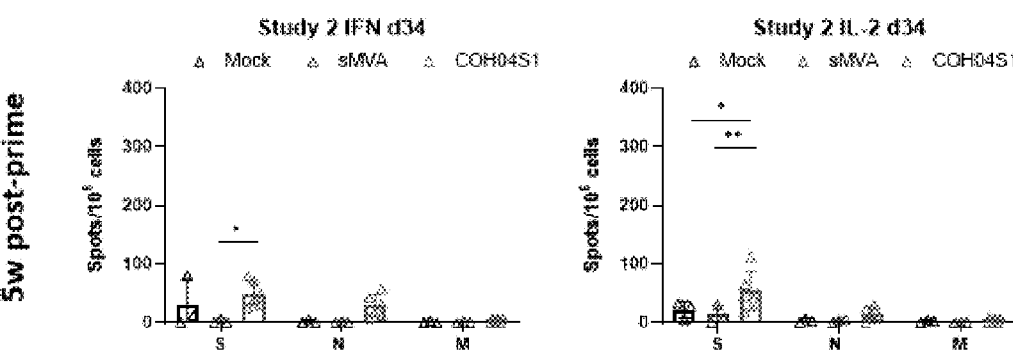
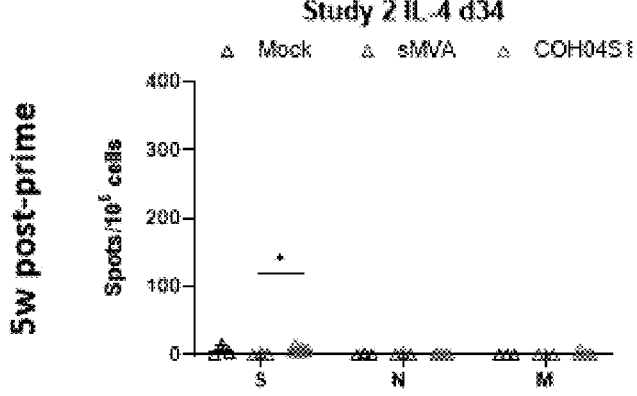

Fig. 42
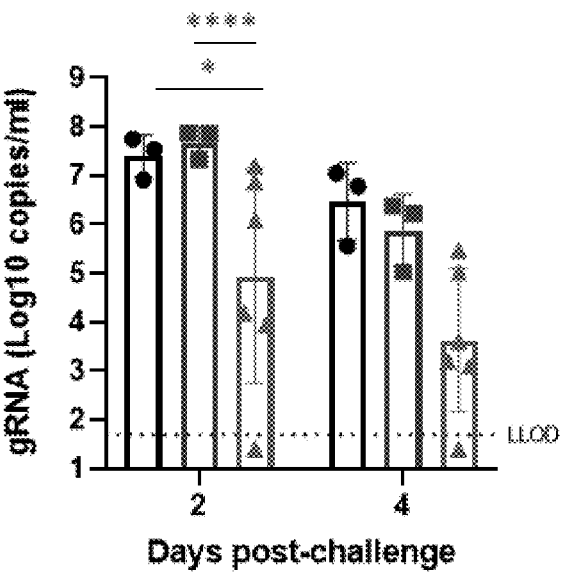
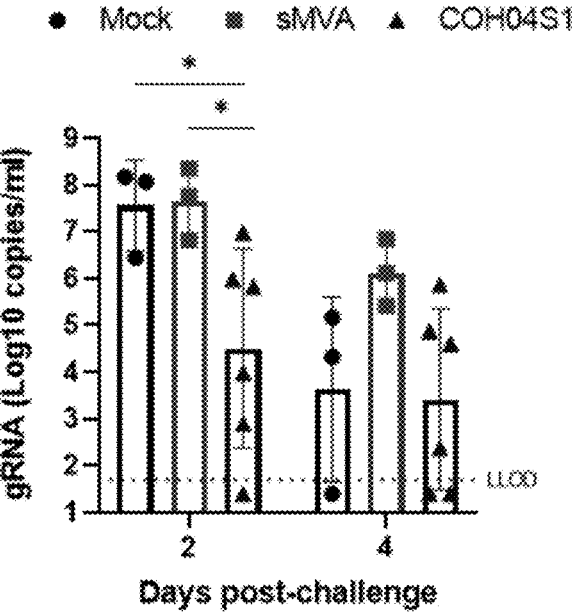

Fig. 43
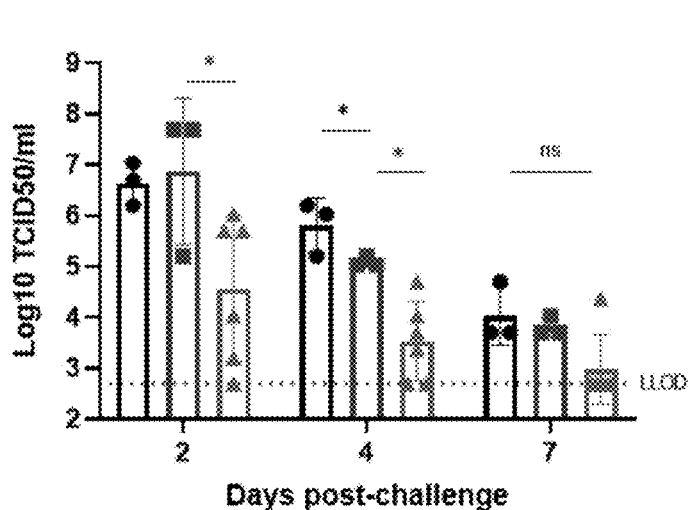
BAL TCID50 Study 1 Prime-Boost
● Mock   ■ sMVA   ▲ COH04S1
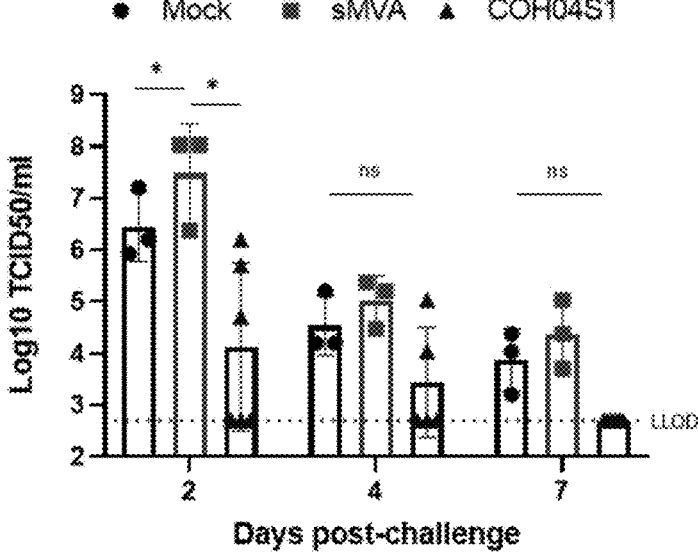
BAL TCID50 Study 2 Prime
● Mock   ■ sMVA   ▲ COH04S1

Fig. 45A
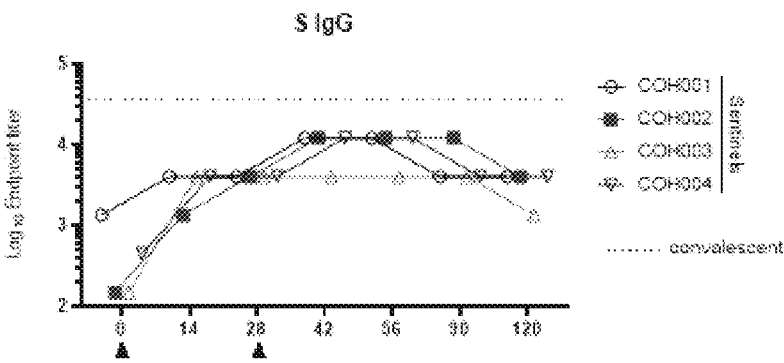
S IgG
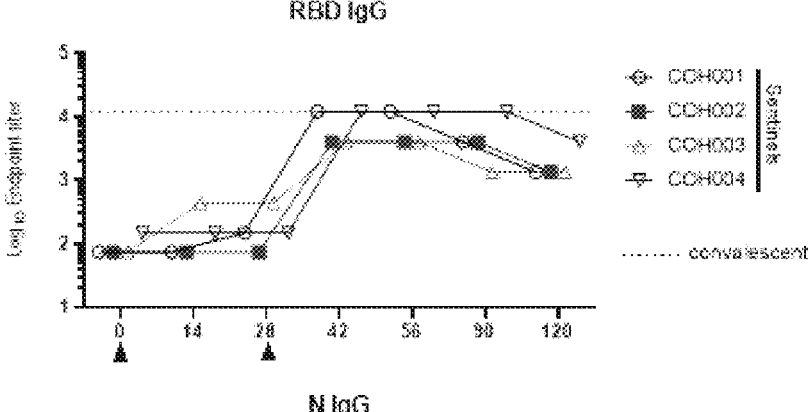
RBD IgG
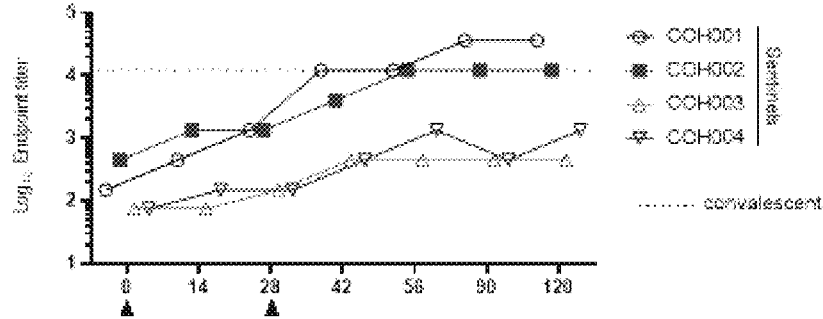
N IgG

Fig. 45B
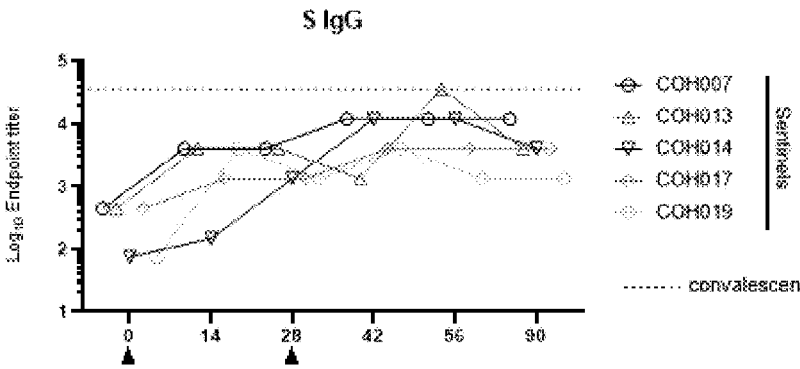
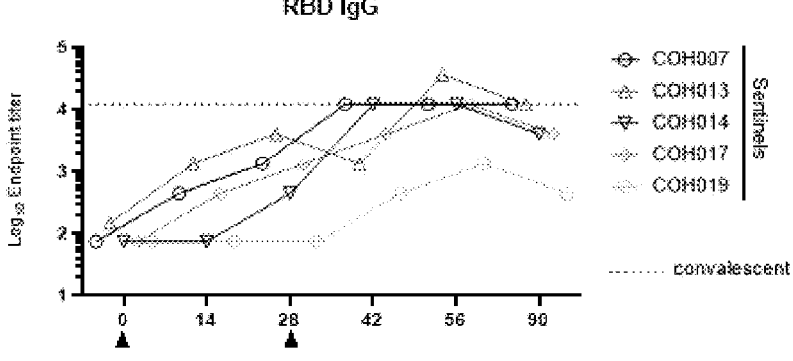
*COH012 primed-only
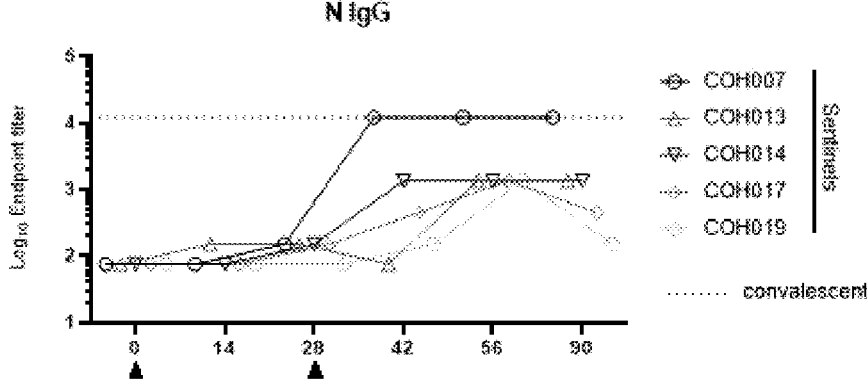

Fig. 45C
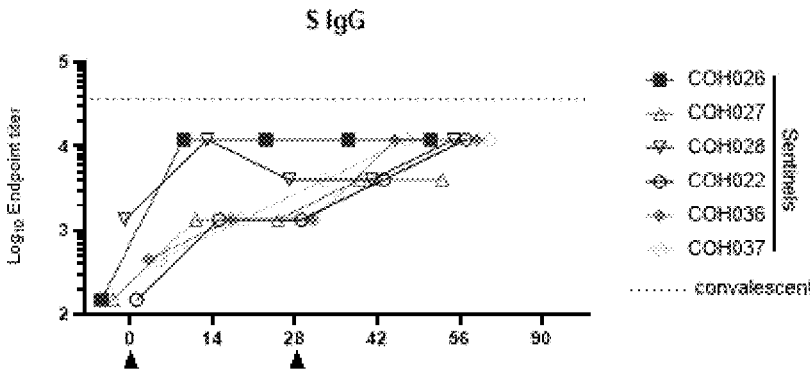
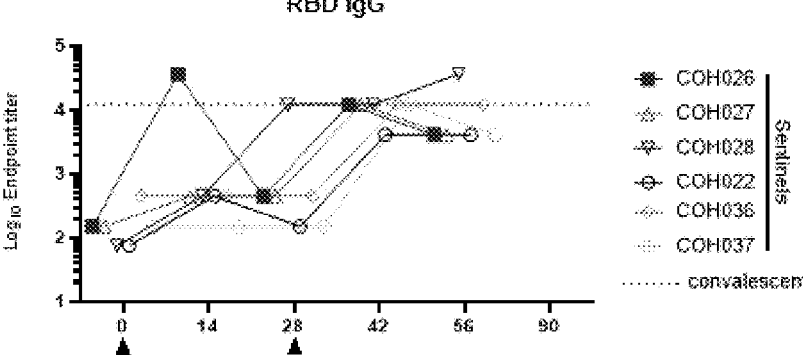
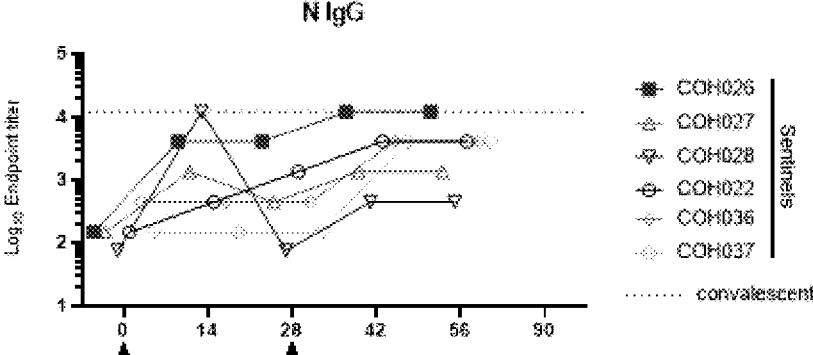

Fig. 46
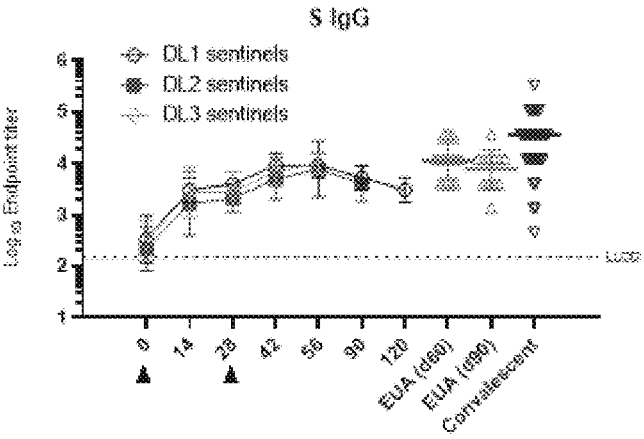
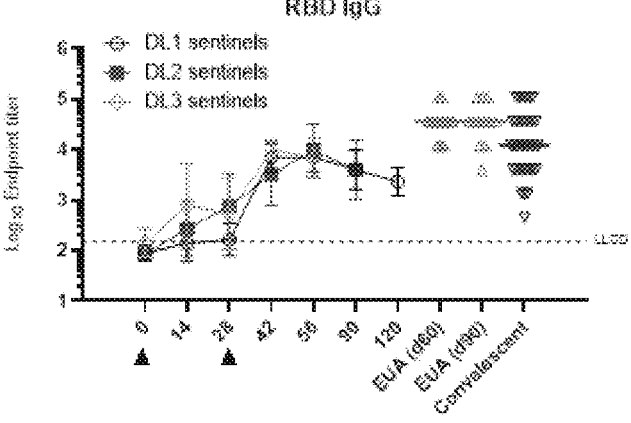
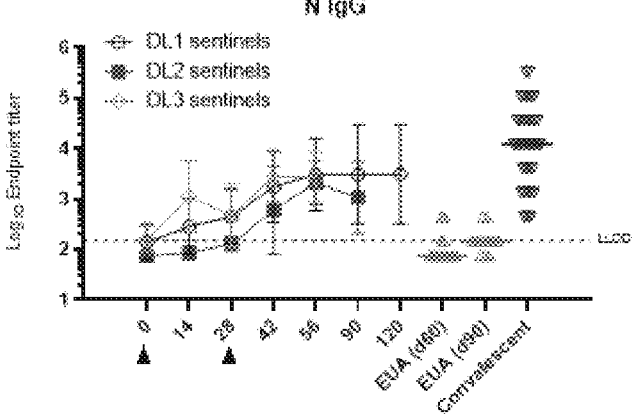

Fig. 47
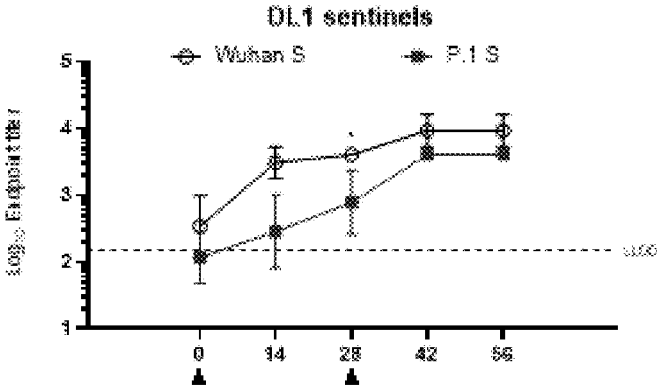
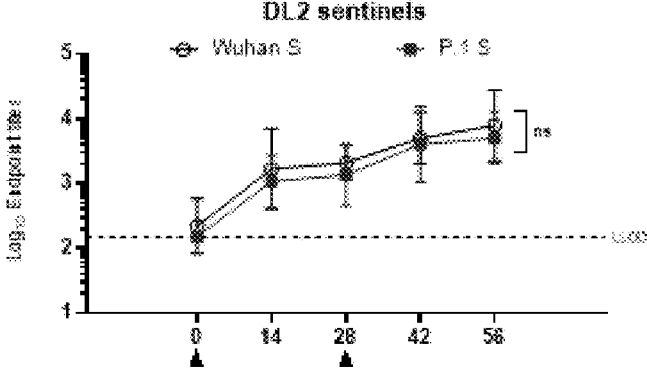
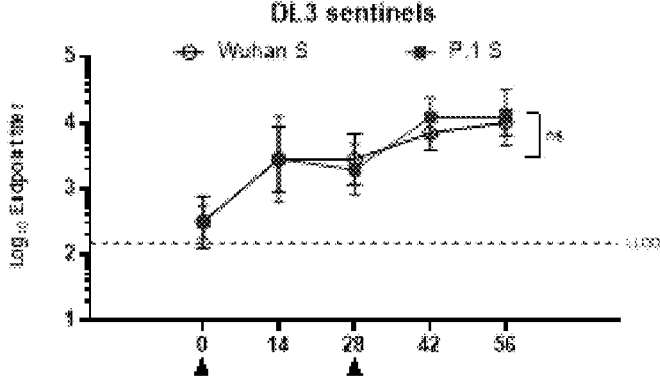

Fig. 48
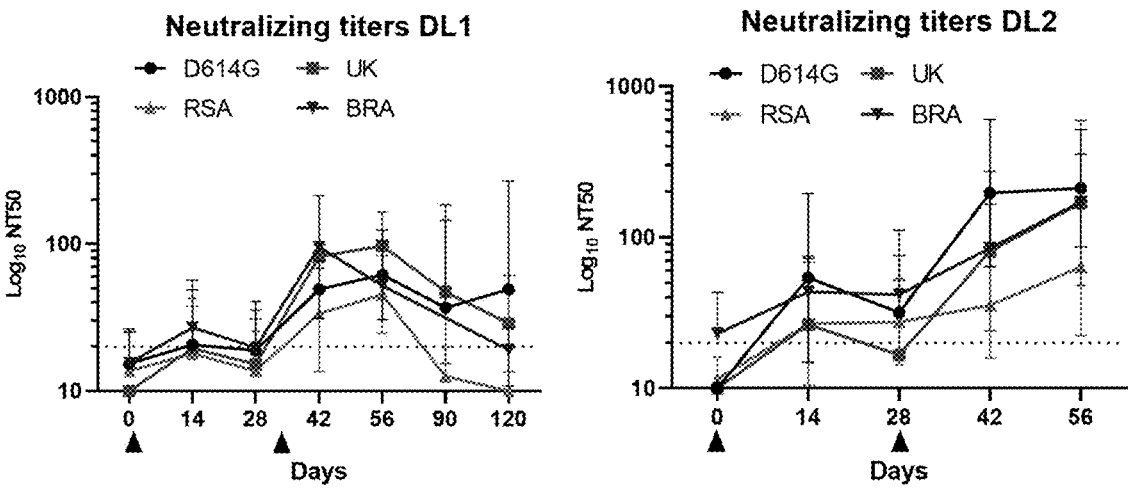
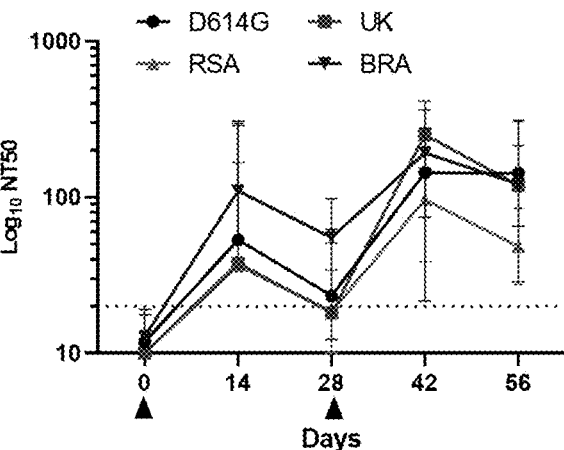

Fig. 49
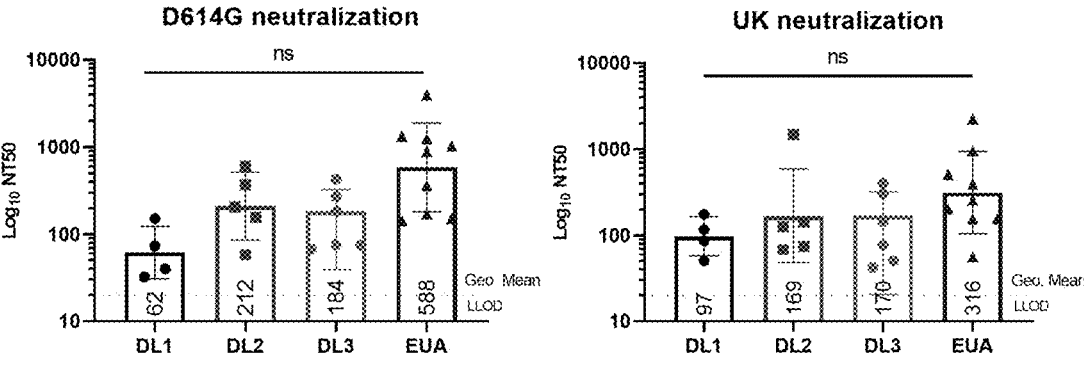
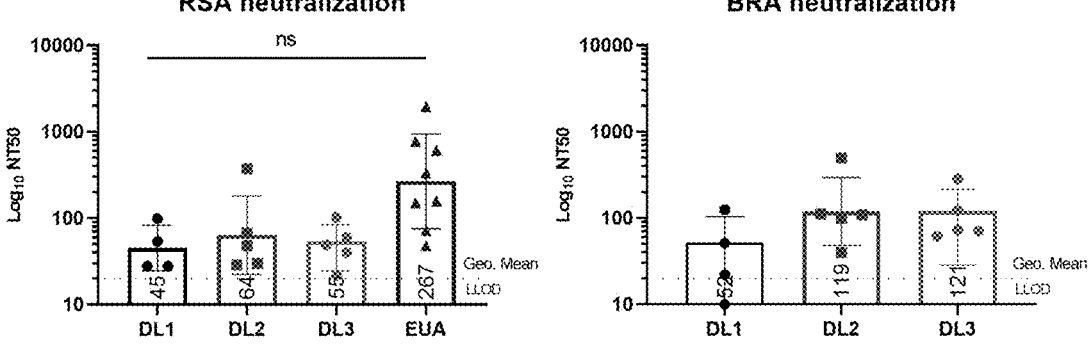

Fig. 50
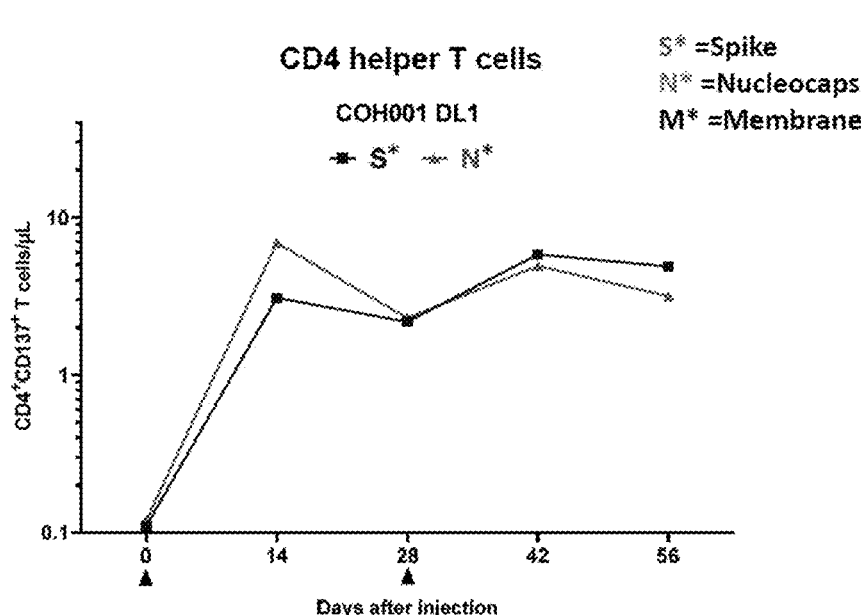
CD137 T cell activation marker
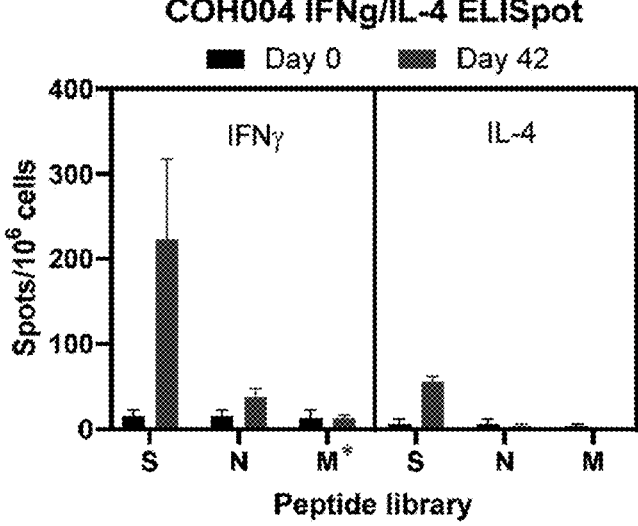
Th1-skewed response Fig. 52
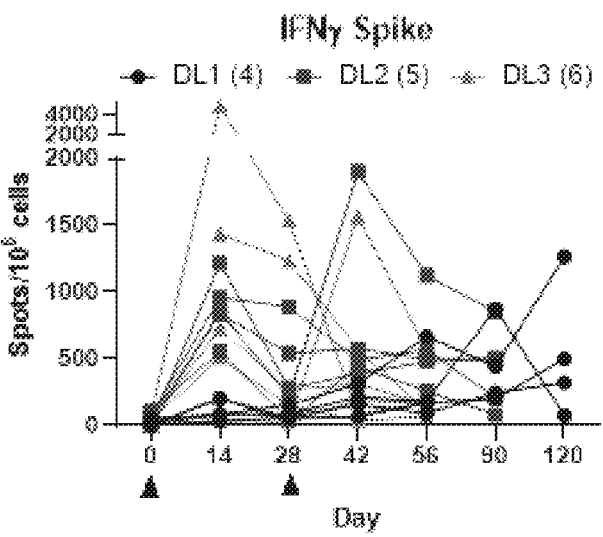
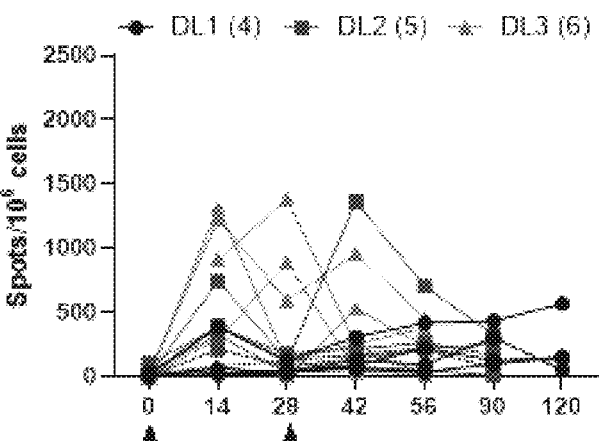

Fig. 52 (cont'd)
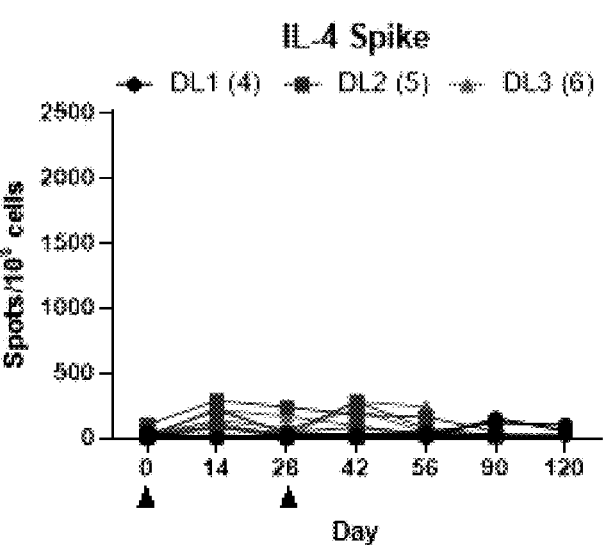
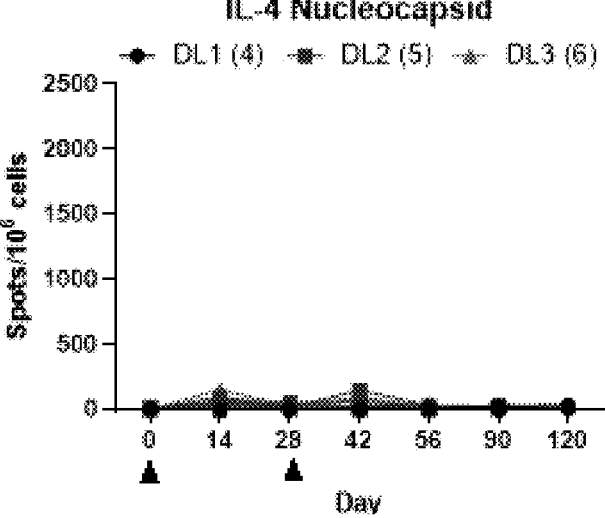

Fig. 54A
Fig. 54B
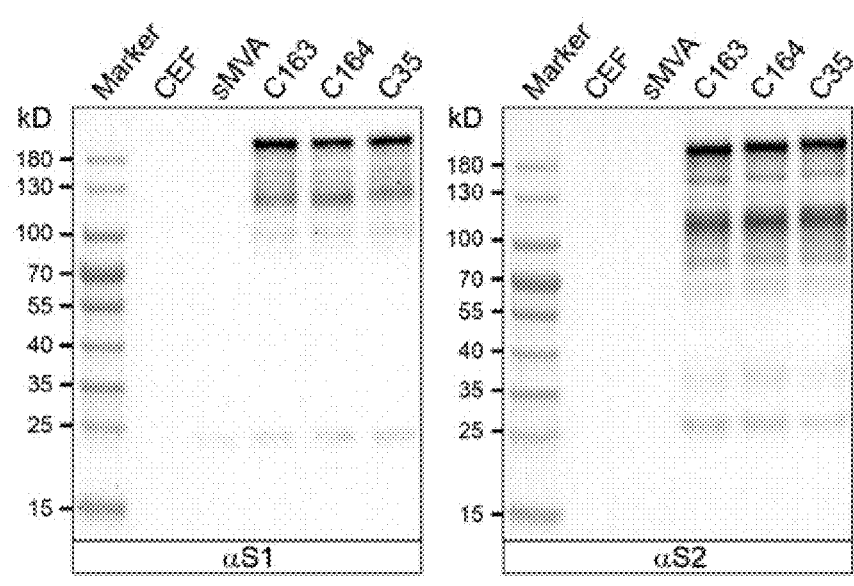
Fig. 54C
Fig. 54D
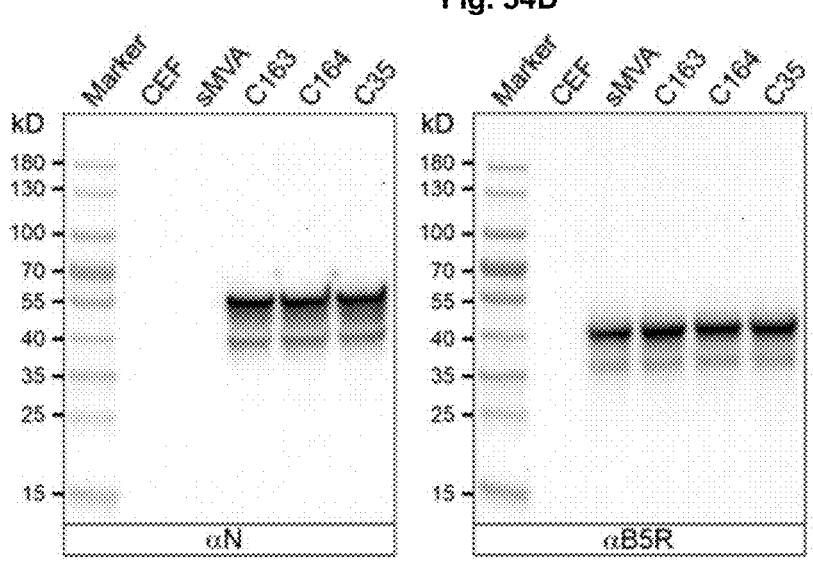

Fig. 55A        Fig. 55B        Fig. 55C
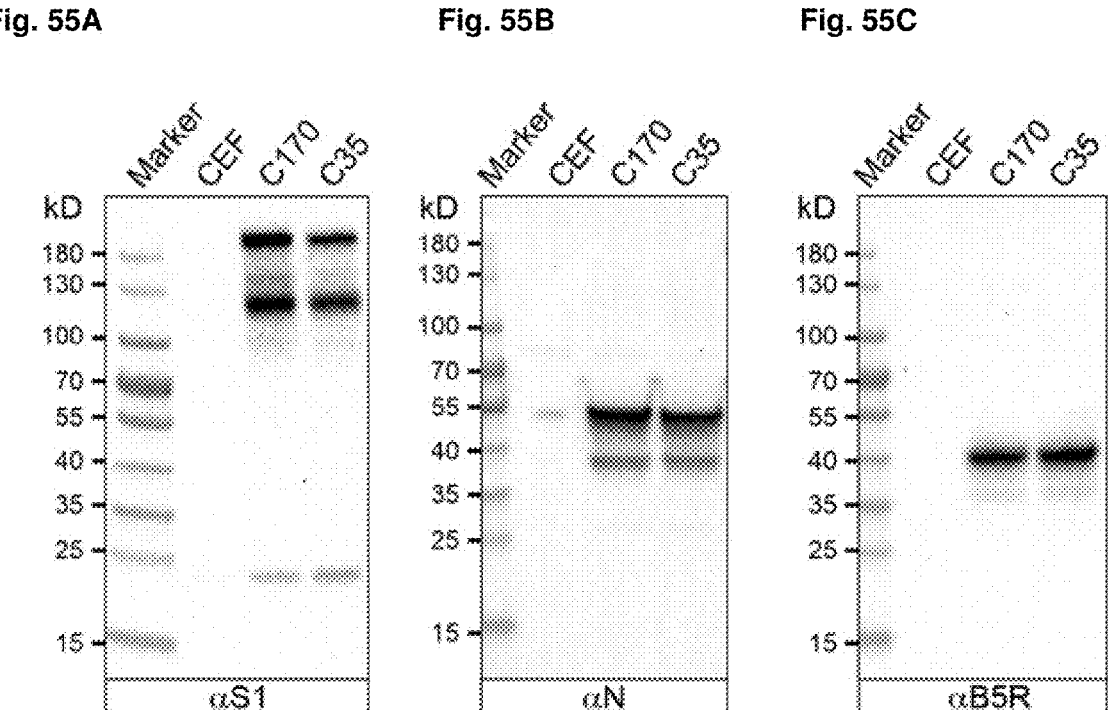

Fig. 58 (cont'd)

aatatattattagtttatattactgaattaataatataaaattcccaatcttgtcataaacacacactgagaaacagcataaacacaaaatccatca
aaaatgttgataaattatctgatgttgttgttcgctgctatgataatcagatcattcgccgatagtggtaacgctatcgaaacgacatcgccagaa
attacaaacgctacaacagatattccagctatcagattatgcggtccagagggagatggatattgtttacacggtgactgtatccacgctagag
atatcgacggtatgtattgtagatgctctcatggttatacaggcattagatgtcagcatgtagtattagtagactatcaacgttcagaaaaaccaa
acactacaacgtcatatatcccatctcccggtattatgcttgtattagtaggcattattattattacgtgttgtctattatctgtttataggttcactcga
cgaactaaactacctatacaagatatggttgtgccataatttttataaattttttttatgagtatttttacaaaaatgtataaagtgtatgtcttatgtata
tttataaaaatgctaaatatgcgatgtatctatgttatttgtatttatctaaacaatacctctacctctagatattatacaaaaattttttatttcggcatat
taaagtaaaatctagttaccttgaaaatgaatacagtgggtggttccgtatcaccagtaagaacataatagtcgaatacagtatccgattgagat
tttgcatacaatactagtctagaaagaaatttgtaatcatcttctgtgacgggagtccatatatctgtatcatcgtcccatgctatattcctgttatca
tcattagttaatgaaaataactctcgtgcttcagaaaagtcaaatattgtatccatacatacatctccaaaactatcgcttatacgtttatctttaacg
atacctatacctagatggttatttactaacagacattttccagatctattgactataactcctatagtttccacatcaaccaagtaatgatcatctatt
gttatataacaataacataactcttttccgttttatcagtatgtatatctatatcaacgtcgtcgttgtagtgaatagtagtcattgatctattatatga
aacggatatgtctagaacggcaattgtttacgtccagttaacactttcgttgatttaaagtctagagtctttgcaaacataatatccttatccgact
ttatatttcctgtagggtggtataatttattttttgcctccacatatcggtgtttccaaatatattactagacaatattccatatagttattagttaagggt
acccaattagaacacgtacgcttattatcatcatttggatcgtatttcataaaagttattgtactatcgatgtcaacacattctacattttttaatcgtct
atatagtattttctgatattttctataatatcagaattgtcttccatcggaagttgtatactatcggaatcagttacatgtttaaataattctctgatgtc
attccttatacaatcaaattcattattaaacagtttaatagtctgtagacctttatcgtcgtaaatatccattgtcttattagttacgcttattttatgtgtt
tttacgttgctttattatattttataagaatgattgtttgacgaatcacgagaactattaagacacattattaggtatatattataaaaaagtttttgatta
cgatgttataagaggaaagaggacacattaacatcatacatcaattaactacattcttataacatcgtaatcaaaagaattgcaatttgatgtata
acaactgtcaatgggttatggaattgtatattacatattatacggtatgttggtaacgacaaataccgatcggtaattgtctgccggtgtaataga
attatatatctatctattacaccggccttgtatacataataataagttgtggtagtatgatctccatatttataatttaggactttgtattcagtttttt
ggaatcataaaaaataaaaaaaagttttactaatttaaaattatttacatttttttcactgtttagtcgcggatatggaattcgatcctgccaaaatca
atacatcatctatagatcatgtaacaatattacaatacatagatgaaccaaatgatataagactaacagtatgcattatcacaaaaataaatccac
atttggctaatcaatttcgggcttggaaaaaacgtatcgccggaaggactatgactaacttatctagagatacaggaatacaacaatcaaa
acttactgaaactgtcaaaaaaatagaaacatatatggtctatatatacactacaatttagttattaattggataaccgatgtgattatcaatcaata
ttaagaaggttggtaaattggtacatagctaataataacctatacacccaataatacaacaaccatttctgagttggatatcatcaaaatactggat
aaatacgaggacgtgtatagagtaagtaaagaaaaagaatgtgaaatttgctatgaagttgtttactcaaaacgatagatactttggtttattgg
attcgtgtaatcatatattttgcataacatgcatcaatatatggcatagaacacgaagagaaaccggtgcgtcggataattgtcctatatgtcgta
cccgttttagaaacataacaatgagcaagttaactaatataaaaaagtttaatttgttgacgacgtatgtcgttattttttctcgtataaaagattaa
tttgattctaatataatctttagtattggataaaatatcaattcaaattaattccattagattatatcataaataaaaatagtagcacgcactacttcagc
caaatattcttttttgaaacgccatctatcgtagtgaggacacaagtgaacctataatgagcaaatttattagtatcggttacatgaaggactttac
gtagagtggtgattccactatctgtggtacgaacggtttcatcttctttgatgccatcacccagatgttctataaacttggtatcctttgccaacca
atacatatagctaaactcaggcatatgttccacacatcctgaacaatgaaattctccagaagatgttacaatgtctagatttggacatttggtttca
accgcgttaacatatgagtgaacacacccatacatgaaagcgatgagaaataggattttcatcttgccaaaatatcactagaaaaaatttattta
tcaatttaaaggtataaaaaatacttattgttgctcgaatattttgtatttgatggtatacggaagattagaaatgtaggtattatcatcaactgattc
tatggtttatgtattctatcatgtttcactattgcgttggaaataatatcatatgcttccacatatatttattttgtttaactcataatactcacgtaatt
ctggattattgacatatctatgaataattttagctccatgatcagtaaatattaatgagaacatagtattaccacctaccattatttttttcatctcattc
aattcttaattgcaaagatctatataatcattatagccgttgacttatggactctggaatcttagacgatgtacagtcatctataatcatggcatattta
atacattgttttatagcatagtcgttatctacgatgttagatatttctctcaatgaatcaatcacacaatctaatgtaggtttatgacataataagcatttt
cagcagttcaatgttttttagattcgttgatggcaatggctatacatgtatatccgttatttgatctaatgttgacatctgaaccggattctagcagta
aagatactagagattgtttattatatctaacagccttgtgaagaagtgtttctcctcgtttgtcaatcatgttaatgtctttaagataaggtaggcaa
atgtttatagtactaagaattgggcaagcataagacatgtcacaaagaccctttttgtatgtataagtgtaaaaattataacattcatagttggattt
acataggtgtccaatcgggatctctccatcatcgagataattgatggcatctcccttccttttttagtagatatttcatcgtgtaagaatcaatatta
atatttctaaagtatccgtgtatagcctctctttatttaccacagttccatattccactagagggatatcgccgaatgtcatatactcaattagtatatgt
tggaggacatccgagttcattgtttttcaatatcaaaaagatggtttccttatcatttctccatagtggtacaatactacacattattccgtgcggcttt

Fig. 58 (cont'd)

ccattttccaaaaacaatttgaccaaatctacatctttattgtatctataatcactatttagataatcagccataattactcgagtgcaacatgttaga
tcgtctatatatgaataagccgtgttatctattcctttcattaacaaatttaacgatgtctatatctatatgagatgacttaatataatattgaagagctgt
acaatagtttttatctataaaagacggcttgattccgtgattaattagacatttaacaacttccggacgcacatatgctctcgtatccgactctgaa
tacagatgagagatgatatacagatgcaatacggtaccgcaatttcgtagttgataatcatcatacgcgtatcagtactcgtcctcataaagaa
cactgcagccatttctatgaacaaatcaataatttcaggaacaggatcatctgtcattacataattttctataactgaacgatggttttcacatttaa
cactcaagtcaaatccatgttctaccaacacctttatcaagtcaacgtctacatttttggatttcatatagctgaatatattaaagtcatttatgttgct
aaatccagtggcttctagtagagccatcgctatatcctttaactttaacatgtctactatttgtgtattcttctaatggggtagctgtctccaatttttg
cgtaatggattagtgccactgtctagtagtagtttgacgacctcgacattattacaatgctcattaaaaaggtatgcgtgtaaagcattattcttga
attggttcctggtatcattaggatctctgtctctcaacatctgtttaagttcatcgagagccacctcctcattttccaaatagtcaaacattttgactg
aatgagctactgtgaactctatacacccacacaactaatgtcattaaatatcatgtcaaaaacttgtacaattattaataaaaataatttagtgttta
aattttaccagttccagattttacacctccgttaaccccacttttacaccactggacgatcctcctccccacattccaccgccaccagatgtata
agtttagatcctttattactaccatcatgtccatggataaagacactccacatgccgccactaccccctttagaagacatattaataagacttaa
ggacaagtttaacaataaaattaatcacgagtaccctactaccaacctacactattatatgattatagtttctattttacagtaccttaactaaagtc
tctagtcacaagagcaatactaccaacctacactattatatgattatagtttctattttataggaacgcgtacgagaaaatcaaatgtctaatttct
aacggtagtgttgataaacgattatcgtcaatggatacctcctctatcatgtcgtctattttcttactttgttctattaacttattagcattatatattattt
gattataaaacttatattgcttattagcccaatctgtaaatatcggattattaacatatcgtttctttgtaggtttatttaacatgtacatcactgtaagc
atgtccgtaccatttatttttaatttgacgcatatccgcaatttctttttcgcagtcggttataaaattctatatatgatggatacatgctacatgtgtactt
ataatcgactaatatgaagtacttgatacatattttcagtaacgatttattattaccacctatgaataagtacctgtgatcgtctaggtaatcaactgt
tttcttaatacattcgatggttggtaatttactcagaataaatttccaatatcttaatatataattctgctatttctgggatatatttatctgccagtataac
acaaatagtaatacatgtaaacccatattttgttattatattaatgtctgcgccattatctattaaccattctactaggctgacactatgcgacttaat
acaatgataaagtatactacatccatgtttatatcatcaatatacggcttacaaagtttagtatcgataacacatccaactcacgcatagagaag
gtagggaataatggcataatatttattaggttatcatcattgtcattatctacaactaagtttccattttttaaaatatactcgacaactttaggatctct
attgccaaattttgaaaatatttattatatgcttaaatctatataatgtagctccttcatcaatcatacatttaataacattgatgtatactgtatgata
agatacatattctaacaatagatcttgtatagaatctgtatatcttttaagaattgtggatattattacgtaaactattacacaattctaaaatataaaa
cgtatcacggtcgaataatagttgatcaactatataattatcgattttgtgattttttcttcctaaactgtttacgtaaatagttagatagaatattcatta
gttcatgaccactatagttactatcgaataacgcgtcaaatatttcccgtttaatatcgcatttgtcaagataataatagagtgtggtatgttcacga
taagtataataacgcatctctttttcgtgtgaaattaaatagtttattacgtccaaagatgtagcataaccatcttgtgacctagtaataatataataa
tagagaactgttttacccattctatcatcataatcagtggtgtagtcgtaatcgtaattgtctaattcatcatcccaattataatattcaccagcacgt
ctaatctgttctattttgatcttgtatccatactgtatgttgctacatgtaggtattcctttatccaataatagtttaaacacatctacattgggatttgat
gttgtagcgtattttctacaatattaataccattttgatactatttatttctataccttcgaaattagtaatttcaataagtctatatcgatgttatcaga
acatagatattcgagtatatcaaaatcattgatattttatagtcgactgacgacaataacaaaatcacaacatcgtttttgatattattattttctctg
gtaacgtatgcctttaatggagtttcaccatcatactcatataatggatttgcaccactttctatcaatgattgtgcactgctggcatcgatgttaaa
tgttttacaactatcatagagtatcttatcgttaaccatgattggttgttgatgctatcgcattttttggtttctttcatttcagttatgtatggatttagca
cgtttgggaagcatgagctcatatgatttcagtactgtagtgtcagtactattagtttcaataagatcaatctctagatctatagaatcaaaacacg
ataggtcagaagataatgaatatctgtaggcttcttgttgtactgtaacttctcgttttgttagatgtttgcatcgtgctttaacatcaatggtacaaa
ttttatcctcgctttgtgtatcatattcgtccctactataaaattgtatattcagattatcatgagatgtgtatacgctaacggtatcaataaacggag
cacaccatttagtcataaccgtaatccaaaaattttaaagtatatcttaacgaaagaagttgtgtcattgtctacggtgtatggtactagatcctc
ataagtgtatatatctagagtaatgtttaatttatcaaatggttgataatatggatcctcatgacaatttccgaagatggaaatgagatatagacat
gcaataaatctaattgcggacatggttactccttaaaaaaatacgaataatcaccttggctatttagtaagtgtcatttaacactatactcatattaa
tccatggactcataatctctatacgggattaacggatgttctatatacggggatgagtagtttcttctttaactttatacttttttactaatcatatttag
actgatgtatgggtaatagtgtttaaagagttcgttctcatcatcagaataaatcaatatctctgttttttttgttatacagatgtattacagcctcatat
attacgtaatagaacgtgtcatctacctattaactttcaccgcatagttgtttgcaaatacggttaatcctttgacctcgtcgatttccgaccaatct
gggcgtataatgaatctaaactttaatttcttgtaatcattcgaaataattttttagtttgcatccgtagttatcccctttatgtaactgtaaatttctcaa
cgcgatatctccattaataatgatgtcgaattcgtgctgtatacccatactgaatggatgaacgaataccgacggcgttaatagtaatttactttttt
catctttacatattgggtactagttttactatcataagtttataaaattccacaagctactatggaataagccaaccatcttagtataacacacatgtct

Fig. 58 (cont'd)

taaagtttattaattaattacatgttgttttatatatcgctacgaatttaaacagagagaaatcagtttaggaaaaaaaaatatctatctacatcatcacg
tctctgtattctacgatagagtgctactttaagatgagacatatccgtgtcatcaaaaatatactccattaaaatgattattccggcagcgaacttg
atattggatatatcacaacctttgttaatatctacgacaatagacagcagtcccatggttccataaacagtgagtttatctttctttgaagagatattt
tgtagagatcttataaaactgtcgaatgacatcgcatttatatctttagctaaatcgtatatgttaccatcgtaatatctaaccgcgtctatcttaaac
gtttccatcgctttaaagacgtttccgatagatggtctcatttcatcagtcatactgagccaacaaatataatcgtgtataacatctttgatagaatc
agactctaaagaaaacgaatcggctttattatacgcattcatgataaacttaatgaaaaatgtttttcgttgtttaagttggatgaatagtatgtctta
ataattgttattatttcattaattaatatttagtaacgagtacactctataaaaacgagaatgacataactagttatcaaagtgtctaggacgcgtaa
ttttcatatggtatagatcctgtaagcattgtctgtattctggagctattttctctatatctaatttctgaacgttcaccaatgtctctagccactttggc
actaatagcgatcattcgcttagcgtcttctatattattaactggttgattcaatctatctagcaatggaccgtcggacagcgtcattctcatgttctt
aatcaatgtacatacatcgccgtcatctaccaattcatccaacaacataagcttttaaaatcatcattataataggtttgatcgttgtcatttctcca
aagaatatatctaataagtagagtcctcatgattagttaacaactattttttatgttaaatcaattagtacaccgctatgtttaatacttattcatatttta
gttttaggattgagaatcaatacaaaaattaatgcatcattaattttagaaatacttagtttccacgtagtcaatgaaacatttgaactcatcgtac
aggacgttctcgtacaggacgtaactataaaccggtttatatttgttcaagatagatacaaatccgataacttttttacgaattctacgggatcca
ctttaaaagtgtcataccgggttcttttatttttttaaacagattaatggtgtgatgttgattaggtcttttacgaatttgatatagaatagcgtttacat
attctccataatggtcaatcgccatttgttcgtatgtcataaattctttaattatatgacactgtgtattatttagttcatccttgttcatcattaggaatct
atccaatatggcaattatactagaactataggtgcgttgtatacacatattgatgtgtctgtttatacaatccatgctactaccttcgggtaaaattg
tagcatcatataccatttctagtactttaggttcattgttatccattgcagaggacgtcatgaacgcatcctaaaaaaatatattattttatgttatttt
gttaaaaataatcatcgaatacgaactagtataaaaaggcgcgccttaggcctgagttgagtcagcactgctcatggattgttgcaattgtttgg
agaaatcatccaaatctgcagcaggaagaagagtcacagtttgctgtttcttctgtctctgcggtaaggcttgagtttcatcagccttcttcttctt
gtccttcttaggctctgttggtgggaatgtcttgtatgcgtcaatatgcttattcagcaatatgacttgatctttgaaatttggatctttgtcatccaat
ttgatggcacctgtgtaggtcaaccacgttcccgaaggtgtgacttccatgccaatgcgcgacattccgaagaacgctgaagcgctgggag
caaattgtgcaatttgcggccaatgtttgtaatcagttccttgtctgattagttcctggtctccaaagtttccttgggtttgttctggaccacgtctgc
cgaaagcttgtgttacattgtatgctttagtggcagtacgtttctgccgaggcttcttagaagcctcagcagcagatttcttagtgacagtttggc
cttgttgttgttggcctttaccagacatcttgctctcaagctggttcaatctgtcaagcagcagcaaagcaagagcagcatcaccgccattgcc
agccattctagcaggagaagttcctctactgctgcctggagttgaatttcttgaactgttgcgactacgtgatgaggaacgagaagaggcttg
actgccgcctctgctcccttctgcgtagaagcctttaggcaatgttgttccttgaggaagttgtagcacgattgcagcattgttagcaggattgc
gggtgccaatgtgatctttaggtgtattcaaggctccctcagttgcaacccatatgatgccgtctttgttagcaccatagggaagtccagcttct
ggcccagttcctaggtagtagaaataccatcttggactgagatctttcatcttaccgtcaccaccacgaattcgtctggtagctcttcggtagta
gccaatttggtcatctggactgctattggtgttaattggaacgccttgtcctcgagggaatttaaggtcttccttgccatgttgagtgagagcggt
gaaccaagacgcagtattattgggtaaaccttgaggccgacgttgtttagatcgcgctccactgcgttctccattctggttactgccagttgaat
ctgagggtccaccaaacgtaatgcgtggtgcgtttcgctgattctgtggtccgttatcagacatggtggcggcgtttatcttatttatgattatttct
cgctttcaatttaacacaaccctcaagaaccctttgtatttattttcaattttgaatcatccagtccactgaatagcaaaatctttactattttggtatctt
ccaatgtggctgcctgatgtaatggaaattcattctctagaagattttcaatgctccagcgttcaacaacgtacatactagacgcacgttattat
cagctattgcataatacaaggcactatgtccatggacatccgccttaaatgcatctttgctagagagaaagcttttcagctgcttagacttccaa
gtattaattcgtgacagatccatgtctgaaacgagacgctaattagtgtataattttttgtcatattgcaccagaattaataatatctctaatagatct
gattagtagatacatggctatcgcaaaacaacatatacacatttaataaaaataatatttattaagaaaattcagatttcacgtacccatcaatata
aataaaataatgattccttacaccgtacccatattaaggagattctaccttacccataaacaatataaatccagtaatatcatgtctgatgatgaac
acaaatggtgtattaaattccagtttttcaggagatgatctcgccgtagctaccataatagtagatgcctctgctacagttccttgttcgtcgacat
ctatctttgcattctgaaacattttataaatatataatgggtccctagtcatatgtttaaacgacgcattatctggattaaacatactaggagccatc
atttcggctatcgacttaatatccctcttattttcgatagaaaatttagggagtttaagattgtacactttattccctaattgaaacgaccaatagtct
aattttgcagccgtaatagaatctgtgaaatgggtcatattatcacctattgccaggtacatactaatattagcatccttatacggaaggcgtacc
atgtcatattctttgtcatcgattgtgattgtatttccttgcaatttagtaactacgttcatcatgggaaccgttttcgtaccgtacttattagtaaaact
agcattgcgtgtttagtgatatcaaacggatattgccatatacctttaaaatatatagtattaatgattgcccatagagtattattgtcgagcatatt
agaatctactacattagacataccggatctacgttctactatagaattaattttattaaccgcatctcgtctaaagtttaatctatataggccgaatct
atgatattgttgataatacgacggtttaatacacacagtattatctacgaaactttgataagttagatcagtgtacgtatatttagatgttttcagctt

Fig. 58 (cont'd)

agctaatcctgatattaattctgtaaatgctggacccagatctcttttctcaaatccatagtcttcaataattctattctagtattacctgatgcaggc
aatagcgacataaacatagaaaacgaataaccaaacggtgagaagacaatattatcatcttgaatattttatacgctactataccggcattggt
aaatccttgtagacgataggtagacgctgaacacgttaacgatagtatcaataacgcaatcatgattttatggtattaataattaaccttatttttat
gttcggtataaaaattattgatgtctacacatcctttgtaattgacatctatatatcctttgtataatcaactctaatcactttaacttttacagttttcc
ctaccagtttatccctatattcaacatatctatccatatgcatcttaacactctctgccaagatagcttcagagtgaggatagtcaaaaagataaat
atatagagcataatcattctcgtatactctgccctttattacatcgcccgcattgggcaacgaataacaaaatgcaagcatcttgttaacgggct
cgtaaattgggataaaaattatgtttttatatctattttattcaagagaatattcaggaatttcttttccggttgtatctcatcgcagtatatatcatttgt
acattgtttcatatttttaatagtttacaccttttagtaggactagtatcgtacaattcatagctgtattttgaattccaatcacgcataaaaatatcttc
taattgttgacgaagacctaatccatcatccggtgtaatattaatagatgctccacatgtatccgtaaagtaatttcctgtccaatttgaggtacct
atataggccgttttatcggttaccatatatttggcatggtttaccctagaatacggaatgggaggatcagcatctggtacaataaatagctttactt
ctatatttatgttttttagatttttagcatagcgatagatcttaaaaagtttctcatgataaacgaagatcgttgccagcaactaatcaatagcttaacg
gatacttgtctgtctatagcggatcttcttaattcatcttctatataaggccaaaacaaaattttacccgccttcgaataaataataggggataaagtt
cataacagatacataaacgaatttactcgcatttctaatacatgacaataaagcggttaaatcattggttctttccatagtacatagttgttgcggt
gcagaagcaataaatacagagtgtggaacaccacttacgttaatactaagaggatgatctgtattataatacgacggataaaagttttttccaatt
atatggtagattgttaactccaagataccagtatacctcaaaaatttgagtgagatccgctgccaagttcctattattgaagatcgcaatacccat
attctttgacctgagttagtgatctccaatccatgttagcgcttcctaaataaatatgtgtattatcagatatccaaaattttgtatgaagaactcctc
ctaggatatttgtaatatctatgtatcgtacttcaactccggccatttgtagtctttcaacatcctttaatggtttgttagatttattgacggctactcta
actcgtactcctcttttgggtaattgtacaatctcgtttaatattatcgtgccgaaattcgtacccacttcatccgataaactccaataaaaagatga
tatatctagtgtttttgtggtattggatagaatttccctccacatgttaaatgtagacaaatatactttatcaaattgcatacctataggaatagtctct
gtaatcactgcgattgtattatccggattcattttatttgttaaaagaataatcctatatcacttcactctattaaaaatccaagtttctatttctttcatg
actgattttttaacttcatccgtttccttatgaagatgatgtttggcaccttcataaattttatttctctattacaatttgcatgttgcatgaaataatatg
cacctaaaacatcgctaatctcattgtttgttccctggagtatgagagtcggggtgttaatcttggaaattattttctaaccttgttggtagccttca
agacctgactagcaaatccagccttaattttttcatgattgattaatgggtcgtattggtatttataaactttatccatatctctagatactgattctgg
acatagctttccgactggcgcatttggtgtgatggttcccataagtttggcagctagcagattcagtcttgaaacagcatctgcattaactagag
gagacattagaatcattgctgtaaacaagtttggattatcgtaagaggctagtatagaaattgttgctcccatggaatgacccaataagtagattt
aatagttaccacgtgctgtaccaaagtcatcaatcatcattttttcaccattacttcttccatgtccaatatgatcatgtgagaatactaaaattccta
acgatgatatgttttcagctagttcgtcataacgtccagaatgtttaccagctccatgacttatgaatactaatgccttaggatatgtaatcattgtc
cagattgaacatacagtttgcactcatgattcacgttatataactatcaatattaacagttcgtttgatgatcatattattttttatgtttattgataattgt
aaaaacatacaattaaatcaatatagaggaaggagacggctactgtctctttgtgagatagtcatggcgactaaattagattatgaggatgctgtt
ttttactttgtggatgatgataaaatatgtagtcgcgactccatcatcgatctaatagatgaatatattacgtggagaaatcatgttatagtgtttaa
caaagatattaccagttgtggaagactgtacaaggaattgatgaagttcgatgatgtcgctatacggtactatggtattgataaaattaatgaga
ttgtcgaagctatgagcgaaggagaccactacatcaattttacaaaagtccatgatcaggaaagtttattcgctaccataggaatatgtgctaa
aatcactgaacattggggatacaaaaagatttcagaatctagattccaatcattgggaaacattacagatctgatgaccgacgataatataaac
atcttgatactttttctagaaaaaaaattgaattgatgatataggggtcttcataacgcataattattacgttagcattctatatccgtgttaaaaaaa
attatcctatcatgtgatttgagagtttttatatgtagcaaacatgatagctgtgatgccaataagctttagatattcacgcgtgctagtgttagggatg
gtattatctggtggtgaaatgtccgttatataatctacaaaacaatcatcgcatatagtatgcgatagtagagtaaacatttttatagtttttactgga
ttcatacatcgtctacccaattcggttatgaatgaaattgtcgccaatcttacacccaaccccttgttatccattagtatagtattaacttcgttatta
tgtcataaactgtaaatgattttgtagatgccatatcatacatgatattcatgtccctattataatcattactaactttatcacaatatatgttgataata
tctatatatgatcgagtctttgtgggcaactgtctatacaagtcgtctaaacgttgtttactcatatagtatcgaacagccatcattacatggtcccg
ttccgttgatagataatcgagtatgttagtggacttgtcaaatctatataccatattttctggaagtggatatacatagtcgtgatcaacattattgct
agcctcatcttctatatcctgtactataccatctacataatctacgatattattacacataaacatcgacaacatactattgttattatctaagtcctg
ttgatccaaacccttgatctcctctatttgtactatctagagattgtacttcttccagttctggataatatatacgttgatagattagctgagctattct
atctccagtatttacattaaacgtacattttccattattaataagaatgactcctatgtttcccctataatcttcgtctattacaccacctcctatatcaa
tgccttttagtgacagaccagacctaggagctattctaccatagcaaatcttaggcatggacatactaatatctgtcttaattaactgtctttctcct
ggagggatagtataatcgtaagcgctatacaaatcatatccggcagcacccggcgattgcctagtaggagatttagctctgttagtttccttaa

Fig. 58 (cont'd)

caaatctaactggtgagttaatattcatgttgaacataaaactaatattttatttcaaaattatttaccatcccatatattccatgaataagtgtgatga
ttgtacacttctatagtatctatatacgattcacgataaaatcctcctatcaatagcagtttattatccactatgatcaattctggattatccctcggat
aaataggatcatctatcagagtccatgtattgctggattcacaataaaattccgcatttctaccaaccaagaataaccttctaccgaacactaac
gcgcatgatttataatgaggataataagtggatggtccaaactgccactgatcatgattgggtagcaaatattctgtagttgtatcagtttcagaa
tgtcctcccattacgtatataacattgtttatggatgccactgctggattacatctaggtttcagaagactcggcatattaacccaagcagcatcc
ccgtggaaccaacgctcaacagatgtgggatttggtagacctcctactacgtataatttattgttagcgggtatcccgctagcatacagtctgg
ggctattcatcggaggaattggaatccaattgtttgatatataatttacagctatagcattgttatgtatttcattgttcatccatccaccgatgagat
atactacttctccaacatgagtacttgtacacatatggaatatatctataatttgatccatgttcataggatactctatgaatggatacttgtatgattt
gcgtggttgtttatcacaatgaaatattttggtacagtctagtatccattttacattatttatacctctgggagaaagataaatttgacctgattacatttt
tgataaggagtagcagatttcctaatttatttcttcgctttatataccacttaatgacaaaatcctcatctggaacatttagttcatcgctttctagaat
aagtttcatagatagataatcaaaattgtctatgatgtcatcttccagttccaaaaagtgtttggcaataaagttttttagtatgacataagagattgg
atagtccgtattctatacccatcatgtaacactcgacacaatattcctttctaaaatctcgtaggatataagtttatacaagtgtagatgataaattct
acagaggttaatatagaagcacgtaataaattgacgacgttatgactatctatatataccttccagtatatgagtaaataactatagaagttaga
ctgtgaatgtcaaggtctagacaaaccctcgtaactggatctttattttttcgtgtattttttgacgtaaatgtgtgcgaaagtaaggagataactttt
t
caatatcgtagaattgactattatattgcctcctatggcatcaataattgttttgaatttcttagtcatagacaatgctaatatattcttacagtacaca
gtattgacaaatatcggcatttatgtttctttaaaagtcaacatctaaagaaaaatgattatcttcttgagacataactcccattttttggtattcaccc
acacgtttttcgaaaaaattagttttaccttctaatgatatatttttccatgaaatcaaacggattggtaacattataaatttttttaaatcccaattcaga
aatcaatctatccgcgacgaattctatatatgttttcatcatttcacaattcattcctataagtttaactggaagagccgcagtaagaaattcttgttc
aatggataccgcatctgttataatagatctaacggtttcttcactcggtggatgcaatataatgtttaaacatcaaacatgcgaagtcgcagtgta
gaccctcgtctctactaatcaattcgttggaaaacgtgagtccgggcattaggccacgctttttaagccaaaatatggaagcgaatgatccgg
aaaagaagattccttctactgcagcaaaggcaataagtctctctccataaccggcgctgtcatgtatccacttttgagcccaatcggccttctttt
ttacacaaggcatcgtttctatggcattaaagagatagtttttttcattactatctttaacataagtatcgatcaaaagactatacatttccgaatgaa
tgttttcaatggccatctgaaatccgtagaaacatctagcctcggtaatctgtacttctgtacaaaatcgttccgccaaattttcattcactattccg
tcactggctgcaaaaaacgccaatacatgttttataaaatattttcgtctggtgttagtttattccaatcattgatatctttagatatatctacttcttcc
actgtccaaaatgatgcctctgcctttttatacatgttccagatgtcatgatattggattgggaaaataacaaatctatttggatttggtgcaaggat
gggttccataactaaattaacaataacaataaattttttttcagttatctatatgcctgtacttggatcttttgtacatcgatatcgccgcaatcactac
aataattacaagtattattgatagcattgttattagtactatcataattaaattatcgttattatcattttgtaattgtgacatcatactagataaatcgttt
gcgagattgttgtgggaagcgggcatggaggatgaattatcgttattattatttaaagcctcccattcggattcacaaatatggcgcgcgttcaa
catttatggaaacagataacaagaaaactcgtcatcgttcaaattttaacgatagtaaaccgattaaacgtcgagctaatttctaacgctagcg
actctgttggatatgggtttccagatatatatcttttcagttcccctacgtatctataatcatctgtaggaaatggaagatatttccatttatctactgtt
cctaatatcatatgtggtggtgtagtagaaccattaagcgcgaaagatgttatttcgcatcgtattttaacttcgcaataatttctggttagataacg
cactctaccagtcaagtcaatgatatattagcctttacagatatattcatagtagtcgtaacgatgactccatcttttagatgcgatactcctttgtatgt
accagaatcttcgtacctcaaactcgatatatttaaacaagttaatgagatattaacgcgtttatgaatgatgatatatataaccagaagtttatcct
cggtggctagcgctataaccttatcattataataccaactagtgtgattaatatgtgacacgttagtgtgggtacaaatatgtacattatcgtctac
gtcgtattcgatacatccgcatacagccaacaaatataaaatgacaaatactctaacgccgttcgtacccatcttgatgcggtttaataaatgttt
tgatttcaatttattgtaaaaaaagattcggttttatactgttcgatattctcattgcttatattttcatctatcatctccacacagtcaaatccgtggtta
gcatgcacctcatcaaccggtaaaagactatcggactcttctatcattataactctagaatatttaatttggtcattattaatcaagtcaattatctta
tttttaacaaacgtgagtattttactcattttttataaaaactttagaaatatacagactctatcgtgtgtctatatcttcttttttatatccaatgtatttat
gtctgattttcttcatttatcatatataatggtccaaattctacacgtgcttcggattcatccagatcattaaggttcttataattgtaacatccttctct
tccctcttctacatcttccttcttattcttattcttagcgtcacagaatctaccacagcaggatcccatgacgagcgtcatattaaactaatccatttt
caattataatatacgattagtaatgaccattaaaataaaaatattcttcataaccggcaagaaagtgaaaagttcacattgaaactatgtcagtag
tatacatcatgaaatgatgatatatatatactctattttggtggaggattatatgatataattcgtggataatcattcttaagacacatttcttcattcgt
aaatcttttcacgttaaatgagtgtccatattttgcaatttcttcatatgatggcggtgtacgtggacgaggctgctcctgttcttgttgtagtcgcc
gactgtcgtgtctgcgtttagatccctccattatcgcgattgcgtagatggagtactatttttataccttgtaattaaatttttttattaattaaacgtata
aaaacgttccgtatctgtatttaagagccagatttcgtctaatagaacaaatagctacagtaaaaataactagaataattgctacacccactaga

Fig. 58 (cont'd)

aaccacggatcgtaatacggcaatcggttttcgataataggtggaacgtatattttatttaaggacttaacaattgtctgtaaaccacaatttgctt
ccgcggatcctgtattaactatctgtaaaagcatatgttgaccgggcggagccgaacattctccgatatccaatttctgtatatctataatattatt
aacctccgcatacgcattacagttctttctagcttggataccgcactaggtacatcgtctagatctattcctatttcctcagcgatagctcttctat
ccttttccggaagcaatgaaatcacttcaataaatgattcaaccatgagtgtgaaactaagtcgagaattactcatgcatttgttagttattcgga
gcgcgcaattttaaactgtcctataacctctcctatatgaatagcacaagtgacattagtagggatagaatgttgagctaattttgtaaataact
atctataaaaagattatacaaagttttaaactctttagtttccgccatttatccagtctgagaaaatgtctctcataataaattttccaagaaactaat
tgggtgaagaatggaaacctttaatctatatttatcacagtctgtttggtacacatgatgaattcttccaatgccgtactaaattcgatatcttttc
gatttctggatatgttttaataaagtatgaacaaagaaatggaaatcgtaataccagttatgtttaactttgaaattgttttttattttcttgttaatgatt
ccagccacttgggaaaagtcaaagtcgtttaatgccgatttaatacgttcattaaaaacaaacttttatcctttagatgaattattattggttcattg
gaatcaaaaagtaagatattatcgggtttaagatctgcgtgtaaaaagttgtcgcagcatggtagttcgtaaattttaatgtataacagagccatc
tgtaaaaagataaactttatgtattgtaccaaagatttaaatcctaatttgatagctagctcggtatctactttatctgccgaatacagtgctaggg
gaaaaattataatatttcctctttcgtattcgtagttagttctcttttcatgttcgaaaaagtgaaacatgcggttaaaatagtttataacattaatatta
ctgttaataactgccggataaaagtgggatagtaattcacgaatttgatactgtcctttctctcgttaaacgcctttaaaaaaacttttagaagaat
atctcaatgatagttcctgaccatccatagtttgtatcaataatagcaacatatgaagaacacgtttatacagagtatgtaaaaatgttaattttatag
tttaatcccatggcccacgcacacacgattaatttttttttcatctccctttagattgttgtatagaaatttgggtactgtgaactccgccgtagtttcc
atgggactatataattttgtggcctcgaatacaaatttactacatagttatctatcttaaagactataccatatcctcctgtagatatgtgataaaaa
tcgtcgtttataggataaaatcgtttatcctttttgttggaaaaaggatgaattaatgtaatcattctcttctatctttagtagtgtttccttattaaaattct
taaaataatttaacaatctaactgatggagcccaattttggtgtaaatctaattgggacattatattgttaaaatacaaacagtctcctaatataaca
gtatctgataatctatggggagacatccattgatattcaggggatgaatcattggcaacacccatttattgtacaaaaagccccaatttacaaac
gaaagtccaggtttgatagagacaaactattaactattttgtctctgttttttaatttctttggtaatgaaattattcacaatatcagtatcttctttatcta
ccagagatttactaacttgataaccttggctgtctcattcaatagggtagtaatatttgtatgtgtgatattgatatcttttagaagtgattctttgatg
gtgccagcatacgaattacaataatgcagaaactcggttaacatgcaggaattatagtaagccaattccaattgttgcctgtgttgtattagagt
gtcaatatgagcaatggtgtccttgcgtttctctgatagaatgcgagcagcgattttggcgttatcatttgacgatatttctggaatgacgaatcct
gtttctactaacttttggtaggacaaagtgaaacaatcaagaagatagcttctcctcctatttgtggaagaaattgaactcctctagatgatctcc
ttgacagatattggaccgaattacagaagtacctggaatgtaaagccctgaaacccccctcattttttaagcagattgttgccgtaaatcctgcac
tatgcccaagatagagagctcctttggtgaatccatctctatgtttcagtttaaccaagaaacagtcagctggtctaaaatttccatctctatctaa
tacagcatctaacttgatgtcaggaactatgaccggttatgttatatgtaacattgagtaaatccttaagttcataatcatcactgtcatcagttatg
tacgatccaaacaatgtttctactggcatagtggatacgaagatgctatccatcagaatgtttccctgattagtattttctatatagctattcttctta
aacgattttccaaatcagtaactatgttcatttttttaggagtaggacgcctagccagtatggaagaggattttctagatcctctcttcaacatcttt
gatctcaatggaatgcaaaaccccatagtgtaacaaccaacgataaaaataatattgtttttcacttttttataattttaccatctgactcatggattc
attaatatctttataagagctactaacgtataattctttataactgaactgagatatatacaccggatctatggtttccataattgagtaaatgaatgc
tcggcaataactaatggcaaatgtataaaacaacgaaattatactagagttgttaaagttaatatttctatgagctgttccaataaattatttgttgt
aactgcgttcaagtcataaatcatcttgatactatccagtaaaccgttttaagttctggaatattattatcccattgtaaagcccctaattcgactat
cgaatatcctgctctgatagcagtttcaatatcgacggacgtcaatactgtaataaaggtggtagtattgtcatcatcgtgataaactactggaat
atggtcgttagtaggtacggtaacttacacaacgcgatatataactttccttttgtaccatttttaacgtagttgggacgtcctgcagggtattgtt
ttgaagaaatgatatcgagaacagatttgatacgatatttgttggattcctgattatttactataatataatctagacagatagatgattcgataaat
agagaaggtatatcgttggtaggataatacatccccattccagtattctcggatactctattaatgacactagttaagaacatgtcttctattctag
aaaacgaaaacatcctacatggactcattaaaacttctaacgctcctgattgtgtctcgaatgcctcgtacaaggatttcaaggatgccatagat
tctttgaccaacgatttagaattgcgtttagcatctgatttttttattaaatcgaatggtcggctctctggtttgctaccccaatgataacaatagtctt
gtaaagataaaccgcaagaaaatttatacgcatccatccaaataaaccctagcaccatcggatgatattaatgtattattatagatttccatccac
agttattgggccagtatactgttagcaacggtatatcgaatagattactcatgtaacctactagaatgatagttcgtgtactagtcataatatctta
atccaatctaagaaatttaaaattagattttttacactgttaaagttaacaaaggtattacccggatacgtggatatcatatatggtattggtccatta
tcagtaatagctccataaactgatacggcgatggtttttatatgtgtttgatctaacgaggaagaaattcgcgcccacaattcatctctagatatgt
atttaatatcaaacggtaacacatcaatttcgggacgcgtatatgttctaaattttttaatccaaatataatgatgacctatgccctattatcatac
tgtcaactatagtacacctagagaacttacgatacatctgtttcctataatcgttaaattttacaaatctataacatgctaaaccttttgacgacaac

Fig. 58 (cont'd)

cattcattaatttctgatatggaatctgtattctcaataccgtatcgttctaaagccagtgctatatctccctgttcgtgagaacgctttcgtataatat
cgatcaacggataatctgaagtttttggagaataaatatgactcatgatctatttcgtccataaacaatctagacataggaattggaggcgatgat
cttaattttgtgcaatgagtcgtcaatcctataacttctaatattgtaatattcatcatcgacataacactatctatgttatcatcgtatattagtatacc
atgaccttcttcatttcgtgccaaaatgatatacagtcttaaatagttacgcaatatctcaatagtttcataattgttagctgttttcatcaaggtttgta
tcctgtttaacatgatggcgttctatacgtttctattttttaaattttttaacgatttactgtggctagatacccaatctctctcaaatattttttagcctcg
cttacaagctgtttatctatactattaaaactgacgaatccgtgattttggtaatgggttccgtcgaaatttgccgaagtgatatgaacatattcgtc
gtcgactatcaacaattttgtattattctgaatagtgaaaaccttcacagatagatcattttgaacacacaacgcgtctagacttctggcggttgc
catagaatatacgtcgttcttatcccaattaccaactagaagtctgatcttaactcctctattaatggctgcttctataatggagttgtaaatgtcgg
gccaatagtagctattaccgtcgacacgtgtagtgggaactatggccaaatgttcaatatctatactagtcttagccgacttgagtttatcaataa
ctacatcagtgtctagatctctagaatatcccaataggtgttccggagaatcagtaaagaacactccacctataggattcttaatatgatacgca
gtgctaactggcagacaacaagccgcagagcataaattcaaccatgaatttttgcgctattaaaggctttaaaagtatcaaatcttctacgaag
atctgtggccagcggggggataatcagaatatacacctaacgttttaatcgtatgtatagatcctccagtaaatgacgcgtttcctacataacatct
ttcattatctgacacccaaaaacaaccgagtagtagtcccacattatttttttttatctatattaacggttataaaattatatccgggcagtgactttgt
agctctcccagatttctttttccctcgttcatctagcaaaactattatttttaatccctttttcagatgcctcttttagtttatcaaaaataagcgctcccct
agtcgtactcagaggattacaacaaaaagatgctatgtatatatatttcttagctagagtgataatttcgttaaaacattcaaatgttgttaaatgat
cggatctaaaatccatattttctggtagtgtttctaccagcctacattttgctcccgcaggtaccggtgcaaatggccacatttagttaacataaa
aacttatacatcctgttctatcaacgattctagaatatcatcggctatatcgctaaaattttcatcaaagtcgacatcacaacctaactcagtcaat
atattaagaagttccatgatgtcatcttcgtctatttctatatccgtatccattgtagattgttgaccgattatcgagtttaaatcattactaatactcaa
tccttcagaatacaatctgtgtttcattgtaaattataggcggtgtatttaagttggtagattttcaattatgtatcaatatagcaacagtagttcttg
ctcctccttgattctagcatcctcttcattattttcttctacgtacataaacatgtccaatacgttagacaacacaccgacgatggcggccgccac
agacacgaatatgactaaaccgatgaccatttaaaaaccccctctctagctttcacttaaactgtatcgattattcttttagaacatgtataatataaa
aacattattctatttcgaatttaggcttccaaaaattttcatccgtaaaccgataataatatatatagacttgttaatagtcggaataaatagattaat
gcttaaactatcatcatctccacgattagagatacaatatttacatttttttgctgtttcgaaactttatcaatacacgttaatacaaacccaggaag
gagatattgaaactgaggctgttgaaaatgaaacggtgaatacaataattcagataatgtaaaatcatgattccgtattctgatgatatattagaact
gctaatggatgtcgatggtatgtatctaggagtatctattttaacaaagcatcgatttgctaatatacaattatcattttgattaattgttatttattcat
attcttaaaaggtttcatatttatcaattcttctacattaaaaaattccatttttaatttatgtagccccgcaatactcctcattacgtttcatttttttgtctat
aatatccattttgttcatctcggtacatagattatccaattgagaagcgcatttagtagttttgtacatttttaagtttattgacgaatcgtcgaaaacta
gttatagttaacattttattatttgataccctgatattaataccccctgccgttactattatttataactgatgtaatccacgtaacattggaattaactat
cgatagtaatgcatcgacgcttccaaaattgtctattataaactcaccgataatttttttattacatgttttcatattcattaggattattaaatctttaat
cttactacgattgtatgcgttgatattgcaagacgtcattctaaaagacggaggatctccatcaaatgccagacaatcacgtacaaagtacatg
gaaataggttttgttctattgcgcatcatagatttatatagaacacccgtagaaatactaatttgttttactctataaaatactaatgcatctatttcat
cgttttgtataacgtctttccaagtgtcaaattccaaatttttttcattgatagtaccaaattcttctatctctttaactacttgcatagataggtaattac
agtgatgcctacatgccgtttttttgaaactgaatagatgcgtctagaagcgatgctacgctagtcacaatcaccactttcatatttagaatatatat
atgtaaaaatatagtagaatttcattttgttttttttctatgctataaatgaattctcattttgcatctgctcatactccgttttatatcaataccaaagaa
ggaagatatctggttctaaaagccgttaaagtatgcgatgttagaactgtagaatgcgaaggaagtaaagcttcctgcgtactcaaagtagat
aaaccctcatcacccgcgtgtgagagaagaccttcgtccccttccagatgcgagagaatgaataacccaggaaaacaagttccgtttatgag
gacggacatgctacaaaatatgttcgcggctaatcgcgataatgtagcttctagacttttgtcctaaaatacaattatatccttttcgatattaataa
atccgtgtcgtccaggtttttatctctttcagtatgtgaatagataggtattttatctctattcatcatcgaatttaagagatccgataaacattgtttg
tattctccagatgtcagcatctgatacaacaatatgtgcacataaacctctggcacttatttcatgtaccttcccccttatcactaaggagaatag
tatttgagaaatatgtatacatgatattatcatgaattagatatacagaatttgtaacactctcgaaatcacacgatgtgtcggcgttaagatctaat
atatcactcgataacacattttcatctagatacactagacatttttaaagctaaaatagtctttagtagtaacagtaactatgcgattatttttcatcg
atgatacatttcatcggcatattattacgcttaccatcaaagactataccatgtgtatatctaacgtattctagcatggttgccatacgcgcattaaa
cttttcaggatctttggatagatcttccaatctatctatttgagaaaacattttttatcatgttcaatagttgaaacgtcggatccactatatagatattat
ctataaagattttaggaactacgttcatggtatcctggcgaatattaaaactatcaatgatatgattatcgttttcatctttttatcaccatatagtttcta
agatatggggatttttacttaatataatattatttcccgtaataaatttttattagaaatgccaaatctataagaaaagtcctcgaattagtttgaagaatat

Fig. 58 (cont'd)

ctatatcgccgtaccgtatatttggattaattagatatagagaatatgatccgtaacatatacaacttttattatggcgtctaagatattcttccatca
acttattaacatttttgactagggaagatacattatgacgtcccattacttttgccttgtctattactgcgacgttcatagaatttagcatatctcttgc
caattcttccattgatgttacattataagaaattttagatgaaattacatttggagctttaatagtaagaactcctaatatgtccgtgtatgtggtcact
aatacagattgtagttctataatcgtaaataatttacctatattatatgtttgagtctgtttagaaaagtagctaagtatacgatcttttatttctgatgc
agatgtatcaacatcggaaaaaaatctttttttattctttttactaaagatacaaatatgtctttgttaaaaacagttattttctgaatatttctagcttgt
aattttaacatatgatattcgttcacactaggtactctgcctaaataggtttctataatctttaatgtaatattaggaaaagtattctgatcaggattcc
tattcattttgaggatttaaaactctgattattgtctaatatggtctcaacacaaacttttcacagagcgatagagttttgataactcgtttttcttaa
gaaatataaaactactgtctccagagctcgctctatctttattttatttaattcgatacaaactcctgatactggttcagaaagtaattcattaattttc
agtcctttatagaagatatttaatatagataatacaaaatcttcagttttgatatcgatctgattgatcctagaactagatatattaataacgtgctca
ttaggcagtttatggcagcttgataattagatatagtatattccagttcatatttattagataccgcattgcccagattttgatattctatgaattcctct
gaaaataaatccaaaataactagacattctattttttgtggattagtgtactctcttccctcatcatgttcactactggtgtccacgatgataaatat
ctagagggaatataatatagtccataggatgccaatctagcaatgtcgaataactgtaatttattcttcgctcttcattatgaattgattcttgaggt
ataaacctaacacaaattatattattagacttttcgtatgtaatgtctttcatgttataagtttttaatcctggaatagaatctattttaatgaggcttta
aacgcagagttctccaacgagtcaaagcataatactctgttggttttcttatatacgatgttacgattttcttctttgaatggaataggtttttgaatta
gtttataattacaacataatagataaggaagtgtgcaaatagtacgcggaaaaaacataatagctcccctgtttcatccatggtttaagtaaat
gatcactggcttctttagtcaatggatattcgaacattaaccgtttcatcatcattggacagaatccatatttcttaatgtaaagagtgatcaaatca
ttgtgtttattgtaccatcttgttgtaaatgtgtattcggttatcggatctgctccttttctattaaagtatcgatgtcgatctcgtctaagaattcaact
atatcgacatatttcatttgtatacacataaccattactaacgtagaatgtataggaagagatgtaacgggaacagggtttgttgattcgcaaact
attctaatacataattcttctgttaatacgtcttgcacgtaatctattatagatgccaagatatctatataattattttgtaagatgatgttaactatgtg
atctatataagtagtgtaataattcatgtatttcgatatatgttccaactctgtctttgtgatgtctagtttcgtaatatctatagcatcctcaaaaaata
tattcgcatatattcccaagtcttcagttctatcttctaaaaaatcttcaacgtatggaatataataatctattttacctcttctgatatcattaatgatat
agtttttgacactatcttctgtcaattgattcttattcactatatctaagaaacggatagcgtccctaggacgaactactgccattaatatctctattat
agcttctggacataattcatctattataccagaattaatgggaactattccgtatctatctaacatagttttaagaaagtcagaatctaagacctgat
gttcatatattggttcatacatgaaatgatctctattgatgatagtgactatttcattctctgaaaattggtaactcattctatatatgctttccttgttga
tgaaggatagaatatactcaatagaatttgtaccaacaaactgttctcttatgaatcgtatatcatcatctgaaataatcatgtaaggcatacattta
acaattagagacttgtctcctgttatcaatatactattcttgtgataattatgtgtgaggcaaatttgtccacgttctttaatttgttatagtagatatc
aaatccaatggagctacagttcttggcttaaacagatatagtttttctggaacgaattctacaacattattataaaggactttgggtagataagtg
ggatgaaatcctattttaattaatgcgatagccttgtcctcgtgcagatatccaaacgcttttgtgatagtatggcattcattgtctagaaacgctct
acgaatatctgtgacagatatcatctttagagaatatactagtcgcgttaatagtactacaatttgtattttttaatctatctcaataaaaaaattaata
tgtatgattcaatgtataactaaactactaactgttattgataactagaatcagaatctaatgatgacgtaaccaagaagtttatctactgccaattt
agctgcattattttagcatctcgtttagattttccatctgccttatcgaatactcttccgtcgatatctacacaggcataaaatgtaggagagttact
aggccccactgattcaatacgaaaagaccaatctctcttagttatttggcagtactcattaataatggtgacagggttagcatctttccaatcaat
aatttttttagccggaataacatcatcaaaagacttatgatcctctctcattgatttttcgcgggatacatcatctattatggcgtcagccataacat
cagcatccggcttatccgcctccgttgtcataaaccaacgaggaggaatatcgtcggagctgtacaccatagcactacgttgaagatcgtac
agagctttattaacttctcgcttctccatattaagttgtctagttagttgtgcagcagtagctccttcgattccaatgttttaatagccgcacacaca
atctctgcgtcagaacgctcgtcaatatagatcttagacattttagagagaactaacacaaccagcaataaaactaatttattttatcattttttat
tcatcatcctctggtggttcgtcgtttctatcgaatgtggatctgattaacccgtcatctataggtgatgctggttctggagattctggaggagatg
gattattatctggaagaatctctgttatttccttgttttcatgtatcgattgcgttgtaacattaagattgcgaaatgctctaaatttgggaggcttaaa
gtgttgtttgcaatctctacacgcatgtctaactagtggaggttcgtcagcggctctagtttgaatcatcatcggcgtagtattcctactttttacagt
taggacacggtgtattgtatttctcgtcgagaacgttaaaataatcgttgtaactcacatcctttatttttatctatattgtattctactcctttcttaatgc
atttataccgaataagagatagcgaaggaattcttttcggtgccgctagtacccttaatcatatcacatagtgttttatattccaaatttgtggca
atagacggtttatttctatacgatagtttgtttctggaatcctttgagtattctataccaatattattctttgattcgaatttagtttcttcgatattagatttt
gtattacctatattcttgatgtagtactttgatgattttccatggcccattctattaagtcttccaagttggcatcatccacatattgtgatagtaattct
cggatatcagtagcggctaccgccattgatgtttgttcattggatgagtaactactaatgtatacattttccatttataacacttatgtattaactttgt
tcatttatattttttcattattatgttgatattaacaaaagtgaatatatatgttaataattgtattgtggttatacggctacaatttcataatgagtggaa

Fig. 58 (cont'd)

gtcagtgtccgatgatcaatgacgatagctttactctgaaaagaaagtatcaaatcgatagtgcggagtcaacaataaaaatggataagaaga
ggataaagtttcagaatagagccaaaatggtaaaagaaataaatcagacaataagagcagcacaaactcattacgagacattgaaactagg
atacataaaatttaagagaatgattaggactactactctagaagatatagcaccatctattccaaataatcagaaaacttataaactattctcgga
catttcagccatcggcaaagcatcacagaatccgagtaagatggtatatgctctgctgctttacatgtttcccaatttgtttggagatgatcatag
attcattcgttatagaatgcatccaatgagtaaaatcaaacacaagatcttctctcctttcaaacttaatcttattagaatattagtggaagaaagat
tctataataatgaatgcagatctaataaatggagaataattggaacacaagttgataaaatgttgatagctgaatctgataaatatacaatagatg
caaggtataacctaaaacccatgtatagaatcaagggaaaatctgaagaagataccctctcttatcaaacagatggtagaacaatgtgtgacat
cccaggaattggtggaaaaagtgttgaagatactgtttagagatttgttcaagagtggagaatacaaagcgtacagatacgatgatgatgtag
aaaatggatttattggattggatacactaaaattaaacattgttcatgatatagttgaaccatgtatgcctgttcgtaggccagtggctaagatact
gtgtaaagaaatggtaaataaatactttgagaatccgctacatattattggtaaaaatcttcaagagtgcattgactttgttagtgaataggcattt
catctttctccaatactaattcaaattgttaaattaataatggatagtataaatagttattagtgataaaatagtaaaaataattattagaataagagt
gtagtatcatagataactctcttctataaaaatggattttattcgtagaaagtatcttatatacacagtagaaaataatatagatttttttaaaggatga
tacattaagtaaagtaaacaattttaccctcaatcatgtactagctctcaagtatctagttagcaattttcctcaacacgttattactaaggatgtatt
agctaataccaatttttttgttttcatacatatggtacgatgttgtaaagtgtacgaagcggtttacgacacgcatttgatgcacccacgttgtacg
ttaaagcattgactaagaattatttatcgtttagtaacgcaatacaatcgtacaaggaaaccgtgcataaactaacacaagatgaaaaattttag
aggttgccgaatacatggacgaattaggagaacttataggcgtaaattatgacttagttcttaatccattatttcacggaggggaacccatcaa
agatatggaaatcatttttttaaaactgtttaagaaaacagacttcaaagttgttaaaaaattaagtgttataagattacttatttgggcttacctaag
caagaaagatacaggcatagagtttgcggataatgatagacaagatatatacactctatttcaacaaactggtagaatagtccatagcaatcta
acagaaacgtttagagattatatctttcccggagataagactagctattgggtgtggttaaacgaaagtatagctaatgatgcggatattgttctt
aatagacacgccattaccatgtatgataaaattcttagttatatatactctgagataaaacaaggacgcgttaataaaaacatgcttaagttagttt
atatctttgagcctgaaaaagatatcagagaacttctgctagaaatcatatatgatattcctggagatatcctatctattattgatgcaaaaaacga
cgattggaaaaaatattttattagttttttataaagctaattttattaacggtaatacatttattagtgatagaacgtttaacgaggacttattcagagtt
gttgttcaaatagatcccgaatatttcgataatgaacgaattatgtctttattctctacgagtgctgcggacattaaacgatttgatgagttagatat
taataacagttatatatctaatataattatgaggtgaacgatatcacattagatacaatggatgatatgaagaagtgtcaaatctttaacgaggat
acgtcgtattatgttaaggaatacaatacatacctgttttgcacgagtcggatcccatggtcatagagaacggaatactaaagaaactgtcatc
tataaaatccaagagtagacggctgaacttgtttagcaaaaacattttaaaatattatttagacggacaattggctcgtctaggtcttgtgttagat
gattataaaggagacttgttagttaaaatgataaaccatcttaagtctgtggaggatgtatccgcattcgttcgatttctacagataaaaaacccta
gtattcttccatcgctaatcaaaactattttagctagttataatatttccatcatcgtcttatttcaaaggttttgagagataatctatatcatgtagaa
gaattcttggataaaagcatccatctaaccaagacggataagaaatatatacttcaattgataagacacggtagatcatagaacagaccaaat
atattattaataatttgtatatacatagatataattatcacacattttgataaatgggaactgctgcaacaattcagactcccaccaaattaatgaat
aaagaaaatgcagaaatgattttggaaaaaattgttgatcatatagttatgtatattagtgacgaatcaagtgattcagaaaataatcctgaatat
attgattttcgtaacagatacgaagactatagatctctcattataaaaagtgatcacgagtttgtaaagctatgtaaaaatcatgcagagaaaagt
tctccagaaacgcaacaaatgattatcaaacacatatacgaacaatatcttattccagtatctgaagtactattaaaacctataatgtccatgggt
gacataattacatataacggatgtaaagacaatgaatggatgctagaacaactctctaccctaaactttaacaatctccgcacatggaactcat
gtagcataggcaatgtaacgcgtctgttttatacattttttagttatctgatgaaagataaactaaatatataagtataatcccattctaatactttaac
ctgatgtattacctgcatcttattagaatattaacctaactaaaagacataacatagttgataaaaagcggtaggatataaatattatggctgcca
ccgttccgcgttttgacgacgtgtacaaaaatgcacaaagaagaattctagatcaagaaacatttttttagtagaggtctaagtagaccgttaatg
aaaaacacatatctatttgataattacgcgtatggatggataccagaaactgcaatttggagtagtagatacgcaaacttagatgcaagtgact
attatcccatttcgttgggattacttaaaaagttcgagtttctcatgtctctatataaaggtcctattcccgtatatgaagaaaaagtaaatactgaat
tcattgctaatggatcgttctctggtagatacgtatcatatcttcgaaagttttctgcccttccaacaaacgagtttattagtttttttgttactgacttcc
attccaatctataatatcttgttctggtttaaaaatactcagtttgatattactaaacacacattattcagatacgtctatacagataatgccaaacac
ctggcgttggctaggtatatgcatcaaacaggagactataagcctttgtttagtcgtctcaaagagaattatatatttaccggtcccgttccaata
agtatcaaagatatagatcaccctaatcttagtagagcaagaagtccatccgattatgagacattagctaatattagtactatattgtactttacca
agtatgatccggtattaatgttttttattgtttttacgtacctgggtattcaattactacaaaaattactccagccgtagaatatctaatggataaactga
atctaacaaagagcgacgtacaactgttgtaaattattttatgcttcgtaaaatgtaggttttgaaccaaacattctttcaaagaatgagatgcata

Fig. 58 (cont'd)

aaactttattatccaatagattgactatttcggacgtcaatcgtttaaagtaaacttcgtaaaatattctttgatcactgccgagtttaaaacttctatc
gataattgtttcatatgtttttaatatttacaagtttttggtccatggtacattagccggacaaatatatgcaaaataatatcgttctccaagttctata
gtttctggattattttattatattcagtaaccaaatacatattagggttatctgcggatttataatttgagtgatgcattcgactcaacataaataattc
tagaggagacgatctactatcaaattcggatcgtaaatctgtttctaaagaacggagaatatctatacatacctgattagaattcatccgtccttc
agacaacatctcagacagtctggtcttgtatgtcttaatcatattcttatgaaacttggaaacatctcttctagtttcactagtacctttattaattctct
caggtacagattttgaattcgacgatgctgagtatttcatcgttgtatatttcttcttcgattgcataatcagattcttatataccgcctcaaactctat
tttaaaattattaaacaatactctattattaatcagtcgttctaactctttcgctatttctatagacttatcgacatcttgactgtctatctctgtaaacac
ggagtcggtatctccatacacgctacgaaaacgaaatctgtaatctataggcaacgatgttttcacaatcggattaatatctctatcgtccatata
aaatggattacttaatggattggcaaaccgtaacataccgttagataactctgctccatttagtaccgattctagatacaagatcattctacgtcct
atggatgtgcaactcttagccgaagcgtatgagtatagagcactatttctaaatcccatcagaccatatactgagttggctactatcttgtacgta
tattgcatggaatcatagatggccttttcagttgaactggtagcctgttttagcatctttttatatctggctctctctgccaaaaatgttcttaatagtc
taggaatggttccttctatcgatctatcgaaaattgctatttcagagatgaggttcggtagtctaggttcacaatgaaccgtaatatatctaggag
gtggatatttctgaagcaagagctgattatttatttcttcttccaatctattggtactaacaacgacaccgactaatgtttccggagatagatttcca
aagatacacacattaggatacagactgttataatcaaagattaatacattattactaaacatttttttgttttggagcaaataccttaccgccttcata
aggaaacttttgttttgtttctgatctaactaagatagtttttagtttccaacaatagctttaacagtggacccttgatgactgtactcgctctatattcg
aataccatggattgaggaagcacatatgttgacgcacccgcgtctgtttttgtttctactccataatactcccacaaatactgacacaaacaagc
atcatgaatacagtatctagccatatctaaagctatgtttagattataatcctatacatctgagctaaatcaacgtcatcctttccgaaagataattt
atatgtatcattaggtaaagtaggacatgatagtacgactttaaatccattttcccaaatatctttacgaattactttacatataatatcctcatcaac
agtcacataattacctgtggttaaaacctttgcaaatgcagcggctttgcctttcgcgtccgtagtatcgtcaccgatgaacgtcatttctctaact
cctctatttaatactttacccatgcaactgaacgcgttcttggatatagaatccaatttgtacgaatccaattttttcagattttttgaatgaatgaatata
gatcgaaaaatatagttccattattgttattaacgtgaaacgtagtattggccatgccgcctactcccttatgactagactgatttctctcataaata
cagagatgtacagcttcctttttgtccggagatctaaagataatcttctctcctgttaataactctagacgattagtaatatatctcagatcaaagtt
atgtccgttaaaggtaacgacgtagtcgaacgttagttccaacaattgtttagctattcgtaacaaaactatttcagaacatagaactagttctcg
ttcgtaatccatttccattagtgactgtatcctcaaacatcctctatcgacgggcttcttgtatttcctgttccgttaacatctcttcattaatgagcgta
aacaataatcgtttaccacttaaatcgatataacagtaacttgtatgcgagattgggttaataaatacagaaggaaacttcttatcgaagtgaca
ctctatatctagaaataagtacgatcttgggatatcgaatctaggtatttttttagcgaaacagttacgtggatcgtcacaatgataacatccattg
ttaatctttgtcaaatattgctcgtccaacgagtaacatccgtctggagatatcccgttagaaatataaaaccaactaatattgagaaattcatcca
tggtggcattttgtatgctgcgtttctttggctcttctatcaaccacatatctgcgacggagcattttctatctttaatatctagattataacttattgtct
cgtcaatgtctatagttctcatctttcccaacggcctcgcattaaatggaggaggagacaatgactgatatatttcgtccgtaactacgtaataaa
agtaatgaggaaatcgtataaatacggtctcgccatttcgacatctggatttcagatataaaaatctgttttcaccgtgactttcaaaccaattaat
gcaccgaacatccatttatagaatttagaaatatattttcatttaaatgaatcccaaacattggggaagagccgtatggaccattattttttatagta
ctttcgcaagcgggtttagacggcaacatagaagcgtgtaaacgaaaactatatactatagtcagcactcttccatgtcctgcatgtagacgg
cacgcgactatcgctatagaggacaataatgtcatgtctagcgatgatctgaattatatttattattttttcatcagattatttaacaatttggcatctg
atcccaaatacgcgatcgatgtgacaaaggttaaccctttataaacttaacccattataaaacttatgattagtcacgactgaaataaccgcgtg
attatttttttggtataattctacacggcatggtttctgtaactatgaattcaacccccgttacattagtgaaatctttaacaaacagcaagggttcgt
caaagacataaaactcattgtttacaatcgaaatagaccccctatcacacttaaaataaaaaatatccttatcctttaccaccaaataaaattctg
attggtcaatgtgaatgtattcacttaacagttccacaaatttatttattaactccgaggcacatacatcgtcggtattttttatggcaaactttactct
tccagcatccgtttctaaaaaaatattaacgagttccatttatatcatccaatattattgaaatgacgttgatggacagatgatacaaataagaag
gtacggtacctttgtccaccatctcctccaattcatgctctattttgtcattaactttaatgtatgaaaacagtacgccacatgcttccatgacagtg
tgtaacactttggatacaaaatgtttgacattagtataattgtccaagactgtcaatctataatagatagtagctataatatattctatgatggtattg
aagaagatgacaatcttggcatattgatcatttaacacagacatggtatcaacagatagcttgaatgaaagagaatcagtaattggaataagc
gtcttctcgatagagtgtccgtataccaacatgtctgatattttgatgtattccattaaattatttagttttttcttttattctcgttaaacagcatttctgt
caacggaccccaacatcgttgaccgattaagttttgattgattttttccgtgtaaggcgtatctagtcagatcgtatagcctatccaataatccatc
atctgtgcgtagatcacatcgtacacttttttaattctctatagaagagcgacagacagcaattctttattctctacagatgtaagatacttgaaga
cattcctatgatgatgcagaattttggataacacggtattgatggtatctgttaccataattcctttgatggctgatagtgtcagagcacaagattt

Fig. 58 (cont'd)

ccaatctttgttttgatatctatatcagacagcatggtgcgtctgacaacacaaggattaagacggaaagatgaaatgattctctcaacatcttca
atggataccttgctatttttctggcattatctatatgtgcgagaatatcctctagagaatcagtatcctttttgatgatagtggatctcaatgacatg
ggacgtctaaaccttcttattctatcaccagattgcatggtgatttgtcttctttcttttatcataatgtaatctctaaattcatcggcaaattgtctatat
ctaaaatcataatatgagatgtttacctctacaaatatctgttcgtccaatgttagagtatctacatcagttttgtattccaaattaaacatggcaac
ggatttaattttatattcctctattaagtcctcgtcgataataacagaatgtagataatcatttaatccatcgtacatggttggaagatgcttgttgac
aaaatctttaattgtcttgatgaaggtgggactatatctaacatcttgattaataaaatttataacattgtccataggatactttgtaactagtttatac
acatctcttcatcggtaagtttagacagaatatcgtgaacaggtggtatattatattcatcagatatacgaagaacaatgtccaaatctatattgttt
aatatattatatagatgtagcgtagctcctacaggaatatctttaactaagtcaatgatttcatcaaccgttagatctattttaaagttaatcatatag
gcattgatttttaaaaggtatgtagccttgactacattctcattaattaaccattccaagtcactgtgtgtaagaagattatattctatcataagcttg
actacatttggtcccgataccattaaagaattcttatgatataaggaaacagattttaggtactcatctactctacaagaattttggagagccttaa
cgatatcagtgacgtttattatttcaggaggaaagaatctaacattgagaatatcggaattaatagcttccagatacagtgattttggcaatagtc
cgtgtaatccataatccagtaacacgagctggtgcttgctagacacctttcaatgtttaatttttttgaaataagctttgataaagccttcctcgca
aattccggatacatgaacatgtcggcgacatgattaagtattgttttttcattattttctcaacaagttctcaataccccaatagatgatagaatatc
acccaatgcgtccatgttgtctatttccaacaggtcgctatatccaccaatagaagttttttccaaaaaagattctaggaacagttctaccaccagt
aatttgttcaaaatagtcacgcaattcattttcgggtttaaattctttaatatcgacaatttcatacgctcctcttttgaaactaaacttatttagaatat
ccagtgcatttctacaaaaaggacatgtatacttgacaaaaattgtcactttgttattggccaacctttgttgtacaaattcctcggccattttaatat
ttaagtgatataaaactatctcgactatttaactctttagtcgagatatatggacgcagatagctatatgatagccaactacagaaggcaaacg
ctataaaaaacataattacgacgagcatatttataaatattttattcagcattacttgatatagtaatattaggcacagtcaaacattcaaccactct
cgatacattaactctctcatttttctttaacaaattctacaatatcttcgtaaaaagattcttgaaacttttttagaatatctatcgactctagatgaaata
gcgttcgtcaacatactatgttttgtatacataaaggcgcccatttttaacagtttctagtgacaaaatgctagcgatcctaggatcctttagaatca
catagattgacgattcgtctctcttagtaactctagtaaaataatcatacaatctagtacgcgaaataatattatccttgacttgaggagatctaaa
caatctagttttgagaacatcgataagttcatcgggaatgacatacatactatctttaatagaactcttttcatccagttgaatggattcgtccttaa
ccaactgattaatgagatcttctattttatcattttccagatgatatgtatgtccattaaagttaaattgtgtagcgcttcttttttagtctagcagccaat
actttaacatcactaatatcgatatacaaaggagatgatttatctatggtattaagaattcgttttcgacatctgtcaaaaccaattccttttgcctg
tatcatccagttttccatcctttgtaaagaaattattttctactagactattaataagactgataaggattcctccataattgcacaatccaaacttttt
aacaaaactagactttacaagatctacaggaatgcgtaattcaggtttcttagcttgtgattttttctttgtggacattttcttgtgaccaactcatct
accatttcattgatttagcagtgaaataagcttcaatgcacgggcactgatactattgaaaacgagttgatcttcaaattccgccatttaagttc
accaaacaactttaaatacaaatatatcaatagtagtagaataagaactataaaaaaaataataattaaccaataccaaccccaacaaccggt
attattagttgatgtgactgttttctcatcacttagaacagatttaacaatttctataaagtctgtcaaatcatcttccggagacccataaatacacc
aaatatagcggcgtacaacttatccatttatacattgaatattggcttttctttatcgctatcttcatcatattcatcatcaatatcaacaagtcccaga
ttacgagccagatcttcttctacattttcagtcattgatacacgttcactatctccagagagtccgataacgttagccaccacttctctatcaatgat
tagtttcttgagtgcgaatgtaattttttgtttccgttccggatctatagaagacgataggtgtgataattgccttggccaattgtctttctcttttactg
agtgattctagttcaccttctatagatctgagaatggatgattctccagtcgaaacatattctaccatggatccgtttaatttgttgatgaagatgga
ttcatccttaaatgtttctctgtaatagtttccaccgaaagactatgcaaagaatttggaatgcgttccttgtgcttaatgtttccatagacggcttc
tagaagttgatacaacataggactagccgcgggtaacttttattttagaaagtatccatcgcttctatcttgtttagatttattttttataaagtttagtct
ctccttccaacataataaaagtggaagtcatttgactagataaactatcagtaagttttatagagatagacgaacaattagcgtattgagaagca
tttagtgtaacgtattcgatacattttgcattagatttactaatcgattttgcatactctataacacccgcacaagtctgtagagaatcgctagatgc
agtaggtcttggtgaagtttcaactctcttcttgattaccttactcatgattaaacctaaataattgtactttgtaatataatgatatatattttcactttat
ctcatttgagaataaaaatgttttgtttaaccactgcatgatgtacagatttcggaatcgcaaaccaccagtggtttattttatccttgtccaatgt
gaattgaatgggagcggatgcgggtttcgtacgtagatagtacattcccgttttttagaccgagactccatccgtaaaaatgcatactcgttagtt
tggaataactcggatctgctatatggatattcatagattgactttgatcgatgaaggctcccctgtctgcagccattttttatgatcgtctttgtgga
atttcccaaatagtttataaaactcgcttaatatcttctggaaggtttgtattctgaatggatccaccatctgccataatcctattcttgatctcatcatt
ccataattttctctcggttaaaaactctaaggagatgcggattaactacttgaaattctccagacaatactctccgagtgtaaatattactggtatac
ggttccaccgactcattatttcccaaaatttgagcagttgatgcagtcggcataggtgccaccaataaactatttctaagaccgtatgttctgattt
tatctttttagaggttcccaattccaaagatccgacggtacaacattccaaagatcatattgtagaataccgttactggcgtacgatcctacatatg

Fig. 58 (cont'd)

tatcgtatggtccttccttctcagctagttcacaactcgcctctaatgcaccgtaataaatggtttcgaagatcttcttatttagatcttgtgcttcca
ggctatcaaatggataatttaagagaataaacgcgtccgctaatccttgaacaccaataccgataggtctatgtctcttattagagatttcagctt
ctggaataggataataattaatatctataattttattgagatttctgacaattactttgaccacatccttcagtttgagaaaatcaaatcgcccatcta
ttacaaacatgttcaaggcaacagatgccagattacaaacggctacctcattagcatccgcatattgtattatctcagtgcaaagattactacac
ttgatagttcctaaattttgttgattactcttttgttacacgcatccttataaagaatgaatggagtaccagtttcaatctgagattctataatcgcttt
ccagacgactcgagcctttattatagatttgtatctcctttctctttcgtatagtgtatacaatcgttcgaactcgtctccccaaacattgtccaatcc
aggacattcatccggacacatcaacgaccactctccgtcatccttcactcgtttcataaagagatcaggaatccaaagagctataaatagatct
ctggttctatgttcctcgtttcctgtattcttttaagatcgaggaacgccataatatcagaatgccacggttccaagtatatggccataactccag
gccgtttgtttcctccctgatctatgtatctagcggtgttattataaactctcaacattggaataataccgtttgatataccattggtaccggagatat
agcttccactggcacgaatattactaattgatagacctattccccctgccattttagagattaatgcgcatcgttttaacgtgtcatagataccctc
tatgctatcatcgatcatgttaagtagaaaacagctagacatttggtgacgactagttcccgcattaaataaggtaggagaagcgtgcgtaaac
catttttcagaaagtagattgtacgtctcaatagctgagtctatatcccattgatgaattcctactgcgacacgcattaacatgtgctgaggtcttt
caacgatcttgttgtttattttcaacaagtaggattttccaaagtttaaaaccaaaatagttgtatgaaaagtctcgttcgtaaataataaccgagt
tgagtttatccttatatttgttaactatatccatggtgatacttgaaataatcggagaatgtttcccatttttaggattaacatagttgaataaatcctc
catcacttcactaaatagttttttgtttccttgtgtagatttgatacggctattctggcggctagaatggcataatccggatgttgtgtagtacaagt
ggctgctatttcggctgccagagtgtccaattctaccgttgttactccattatatattccttgaataaccttcatagctattttaataggatctatatga
tccgtgtttaagccataacataattttctaatacgagacgtgatttatcaaacatgacattttccttgtatccatttcgtttaatgacaaacatttttgtt
ggtgtaataaaaaaaattatttaacttttcattaatagggatttgacgtatgtagcgtacaaaattatcgttcctggtatatagataaagagtcctat
atatttgaaaatcgttacggctcgattaaactttaatgattgcatagtgaatatatcattaggatttaactccttgactatcatggcggcgccagaa
attaccatcaaaagcattaatacagttatgccgatcgcagttagaacggttatagcatccaccatttatatctaaaaattagatcaaagaatatgt
gacaaagtcctagttgtatactgagaattgacgaaacaatgtttcttacatatttttttttttattagtaaccgacttaatagtaggaactggaaaact
agacttgattattctataagtatagatacccttccaaataatattctctttgataaaagttccagaaaatgtagaattttttaaaaagttatcttttgcta
ttaccaagattgtgtttagacgcttattattaatatgagtgatgaaatccacaccgcctctagatatcgcttttatttccacattagatggtaaatcca
atagtgaaactatcttttaggaatgtatggactcgcgtttagaggagtgaacgtcttaggcgtcggaaaggatgattcatcaaacgaataaac
aatttcacaaatggatgttaatgtattagtaggaaattttttgacgctagtggaattgaagattctaatggatgatgttctacctatttcatccgataa
catgttaatttccgacaccaacggtttaatatttcgatgatatacggtagtctctcttcggacttatatagcttattccacaatacgagtcattatat
actccaaaaaacaaaataactagtataaaatctgtatcgaatgggaaaaacgaaattatcgacataggtatagaatctggaacattgaacgtat
taatacttaattcttttctgtggtaagtaccgataggttattgacattgtatggtttaaatattctataacttgagacttgatagatattagtgatgaat
tgaaaattattttttatcaccacgtgtgtttcaggatcatcgtcgacgcccgtcaaccaaccgaatggagtaaaataaatatcattaatatatgctct
agatattagtatttttatcaatcctttgattatcatcttctcgtaggcgaatgattccatgatcaagagtgatttaagaacatcctccggagtattaat
gggcttagtaaacagtccatcgttgcaataataaaagttatccaagttaaaggatattatgcattcgtttaaagatatcacctcatctgacggaga
caatttttggtaggtttagagactttgaagctacttgtttaacaaagttattcatcgtcgtttactattctatttaattttgtagttaatttatcacatatc
acattaattgacttttttggtccattttttccatacgtttatattcttttaatcctgcgttatccgtttccgttatatccagggatagatcttgcaagttaaat
agaatgctcttaaataatgtcattttcttatccgctaaaaatttaaagaatgtataaaccttttcagagatttgaaactcttaggtggtgtcctagta
cacaatatcataaacaaactaataaacattccacattcagattccaacagctgattaacttctacattaatacagcctattttcgctccaaatgtac
attcgaaaaatctgaataaaacatcgatgtcacaatttgtattatccaatacagaatgtttgtgattcgtgttaaaaccatcggagaaggaataaa
aataaaaattattatagtggtggaattcagttggaatattgcctccggagtcataaaaggatactaaacattgtttttttatcataaattacacatttcc
aatgagacaaataacaaaatccaaacattacaaatctagaggtagaacttttaattttgtctttaagtatatacgataagatatgtttattcataaac
gcgtcaaattttttcatgaatcgctaaggagtttaagaatctcatgtcaaattgtcctatataatccacttcggatccataagcaaactgagagact
aagttcttaatacttcgattgctcatccaggctcctctctcaggctctattttcatcttgacgacctttggattttcaccagtatgtattccttacgtg
ataaatcatcgattttcaaatccatttgtgagaagtctatcgccttagatacttttcccgtagtcgaggtttaaagaaatacgctaacggtatacta
gtaggtaactcaaagacatcatatatagaatggtaacgcgtctttaactcgtcggttaactctttcttttgatcgagttcgtcgctactattgggtct
gctcaggtgccccgactctactagttccaacatcataccgataggaatacaagacactttgccggcggttgtagatttatcatatttctccacta
catatccgttacaatttgttaaaaaatttagatacatctatattgctacataatccagctagtgaatatatatgacataataaattggtaaatcctagtt
ctggtattttactaattactaaatctgtatatctttccatttatcatggaaaagaatttaccagatatcttcttttttccaaactgcgttaatgtattctctt

Fig. 58 (cont'd)

acaaatattcacaagatgaattcagtaatatgagtaaaacggaacgtgatagtttctcattggcggtgtttccagttataaaacatagatggcat
aacgcacacgttgtaaaacataaaggaatatacaaagttagtacagaagcacgtggaaaaaaagtatctcctccatcactaggaaaacccg
cacacataaacctaaccgcgaagcaatatatatacagtgaacacacaataagctttgaatgttatagttttctaaaatgtataacaaatacagaa
atcaattcgttcgatgagtatatattaagaggactattagaagctggtaatagtttacagatatttccaattccgtaggtaaacgaacagatacta
taggtgtactagggaataagtatccatttagcaaaattccattggcctcattaactcctaaagcacaacgagagatattttcagcgtggatttctc
atagacctgtagttttaactggaggaactggagtgggtaagacgtcacaggtacccaagttattgctttggtttaattatttatttggtggattctct
actctagataaaatcactgactttcacgaaagaccagtcattctatctcttcctaggatagctttagttagattgcatagcaataccatttaaaatc
attgggatttaaggtactagatggatctcctatttctttacggtacggatctataccggaagaattaataaacaaacaaccaaaaaaatatggaa
ttgtatttctacccataagttatctctaacaaaactatttagttatggcactcttattatagacgaagttcatgagcatgatcaaataggagatatta
ttatagcagtagcgagaaagcatcatacgaaaatagattctatgtttttaatgactgccacgttagaggatgacagggaacggctaaaagtatt
tttacctaatcccgcatttatacatattcctggagatacactgtttaaaattagcgaggtatttattcataataagatcaaatccatcttccagaatgg
catacatagaagaagaaaagagaaatttagttactgctatacagatgtatactcctcctgatggatcatccggtatagtctttgtggcatccgttg
cacagtgtcacgaatataaatcatatttagaaaaaagattaccgtatgatatgtatattattcatggtaaggtcttagatatagacgaaatattaga
aaaagtgtattcatcacctaatgtatcgataattatttctactccttatttggaatccagccgttactatacgcaatgttacacacatttatgatatggg
tagagtttttgtccccgctccttttggaggatcgcaagaatttatttctaaatctatgagagatcaacgaaaaggaagagtaggaagagttaatc
ctgggacatacgtatatttctatgatctgtcttatatgaagtctatacagcgaatagattcagaatttctacataattatatattgtacgctaataagtt
taatctaacactccccgaagatttgtttataatccctacaaatttggatattctatggcgtacaaaggaatatatagactcgttcgatattagtaca
gaaacatggaataaattattatccaattattatatgaagatgatagagtatgctaaactttatgtactaagtcctattctcgctgaggagttggata
attttgagaggacgggagaattaactagtattgtacaagaagccattttatctctaaatttacgaattaagattttaaattttaaacataaagatgat
gatacgtatatacacttttgtaaaatattattcggtgtctataacggaacaaacgctactatatattatcatagacctctaacgggatatatgaatat
gatttcagatactatatttgttcctgtagataataactaaaaatcaaactctaatgaccacatcttttttttagagatgaaaaattttccacatctcctttt
gtagacacgactaaacattttgcagaaaaaagttattagtgtttagataatcgtatacttcatcagtgtagatagtaaatgtgaacagataaaag
gtattcttgctcaatagattggtaaattccatagaatatattaatcctttcttcttgagatcccacatcatttcaaccagagacgtttatccaatgatt
tacctcgtactataccacatacaaaactagattttgcagtgacgtcgtatctggtattcctaccaaacaaaattttacttttagttctttttagaaaatt
ctaaggtagaatctctatttgccaatatgtcatctatggaattaccactagcaaaaaatgatagaaatatatattgatacatcgcagctggttttga
tctactatactttaaaaacgaatcagattccataattgcctgtatatcatcagctgaaaaactatgtttacacgtattccttcggcatttctttttaatg
atatatcttgtttagacaatgataaagttatcatgtccatgagagacgcgtctccgtatcgtataaatatttcattagatgttagacgcttcattagg
ggtatacttctataaggtttcttaatcagtccatcattggttgcgtcaagaactactatcggatgttgttgggtatctctagtgttacacatggcctta
ctaaagtttgggtaaataactatgatatctctattaattatagatgcatatatttcatttgtcaaggatattagtatcgacttgctatcgtcattaatac
gtgtaatgtaatcatataaatcatgcgatagccaaggaaaatttaaatagatgttcatcatataatcgtcgctataattcatattaatacgttgacat
tgactaatttgtaatatagcctcgccacgaagaaagctctcgtattcagtttcatcgataaaggataccgttaaatataactggttgccgatagtc
tcatagtctattaagtggtaagtttcgtacaaatacagaatccctaaaatattatctaatgttggattaatctttaccataactgtataaaatggaga
cggagtcataactattttaccgtttgtacttactggaatagacgaaggaataatctccggacatgctggtaaagacccaaatgtctgtttgaaga
aatccaatgttccaggtcctaatctcttaacaaaaattacgatattcgatcccgatatcctttgcattctatttaccagcatatcacgaactatattaa
gattatctatcatgtctattctcccaccgttatataaatcgcctccgctaagaaacgttagtatatccatacaatggaatacttcatttctaaaatagt
attcgtttctaattctttaatgtgaaatcgtatactagaaagggaaaaattatctttgagttttccgttagaaaagaaccacgaaactaatgttctg
attgcgtccgattccgttgctgaattaatggatttacaccaaaaactcatataacttctagatgtagaagcattcgctaaaaaattagtagaatca
aaggatataagtagatgttccaacaagtgagcaattcccaagatttcatctatatcattctcgaatccgaaattagaaattcccaagtagatatcc
tttttcatccgatcgttgatgaaaatacgaactttattcggtaagacaatcatttactaaggagtaaaataggaagtaatgttcgtatgtcgttatca
tcgtataaattaaaggtgtgtttttttaccattaagtgacattataattttaccaatattggaattataatataggtgtatttgcgcactcgcgacggttg
atgcatcggtaaatatagctgtatctaatgttctagtcggtatttcatcatttcgctgtctaataatagcgttttctctatctgtttccattacagctgcc
tgaagtttattggtcggataatatgtaaaataataagaaatacatacgaataacaaaaataaaataagatataataaagatgccatttagagatct
aattttgtttaacttgtccaaattcctacttacagaagatgaggaatcgttggagatagtgtcttccttatgtagaggatttgaaatatcttatgatga
cttgataacttacttccagataggaaataccataaatatatttctaaagtatttgaacatgtagatttatcggaggaattaagtatggaattccatg
atacaactctgagagatttagtctatcttagattgtacaagtattccaagtgtatacggccgtgttataaattaggagataatctaaaaggcatagt

Fig. 58 (cont'd)

tgttataaaggacaggaatatttatattagagaagcaaatgatgacttgatagaatatctcctcaaggaatacactcctcagatttatacatattct
aatgagcgcgtccccataactggttcaaaattaattctttgtggattttctcaagttacatttatggcgtatacaacgtcgcatataacaacaaata
aaaaggtagatgttctcgtttccaaaaaatgtatagatgaactagtcgatccaataaattatcaaatacttcaaaatttatttgataaaggaagcg
gaacaataaacaaaatactcaggaagatattttattcggtaaccggtggccaaactccataatttgcttttctatttcggattttagaatttccaaa
ttcaccagcgatttatcggttttggtgaaatccaaggatttattaatgtccacaaatgccatttgttttgtctgtggattgtatttgaaaatggaaacg
atgtagttagatagatgcgctgcaaagtttcctattagggttccgcgctttacgtcacccagcatacttgaatcaccatcctttaaaaaaaatgat
aagatatcaacatggagtatatcatactcggattttaattcttctactgcatcactgacattttcacaaatactacaatacggttaccgaaaataat
cagtacgttcttcatttatgggtatcaaaaacttaaaatcgttactgctggaaaataaatcactgacgatattagatgataatttatacaaagtatac
aatggaatatttgtggatacaatgagtatttatatagccgtcgccaattgtgtcagaaacttagaagagttaactacggtattcataaaatacgta
aacggatgggtaaaaaaggggaggcatgtaacccttttatcgatagaggaagtataaaaattaaacaagacgttagagacaagagacgta
aatattctaaattaaccaaggacagaaaaatgctagaattagaaaagtgtacatccgaaatacaaaatgttaccggatttatggaagaagaaat
aaaggcagaaatgcaattaaaaatcgataaactcacatttcaaatatatttatctgattctgataacataaaaatatcattgaatgagatactaaca
catttcaacaataatgagaatgttacattattttattgtgatgaacgagacgcagaattcgttatgtgtctcgaggctaaaacacatttctctacca
caggagaatggccgttgataataagtaccgatcaggatactatgctatttgcatctactgataatcatcctaagatgataaaaaaacttaactcaa
ctgtttaaatttgttccctcggcagaggataactatttagcaaaattaacggcgttagtgaatggatgtgatttctttcctggactctatggggcat
ctataacacccaccaacttaaacaaaatacaattgtttagtgattttacaatcgataatatagtcactagtttggcaattaaaaattattatagaaag
actaactctaccgtagacgtgcgtaatattgttacgtttataaacgattacgctaatttagacgatgtctactcgtatgttcctccttgtcaatgcac
tgttcaagaatttatattttccgcattagatgaaaaatggaacaattttaaatcatcttatttagagaccgttccgttaccctgccaattaatgtatgc
attagaaccacgcaaggagattgatgtttcagaagttaaaactttatcatcttatatagatttcgaaaatactaaatcagatatcgatgttataaaat
ctatatcttcgatcttcggatattctaacgaaaactgtaacactatagtgttcggcatctataaggataatttactactgagtataaatagttcatttt
actttaacgatagtctgttaataaccaatactaaaagtgataatataataaatataggttactagattaaaaatggtgttccaactcgtgtgctctac
gtgcggcaaagatatttctcacgaacgatataaattgattatacgaaaaaaatcattaaaggatgtactcgtcagtgtaaagaacgaatgttgta
ggttaaaattatctacacaaatagaacctcaacgtaacttaacagtgcaacctctattggatataaactaatatggatccggttaatttatcaaga
catatgcgcctagaggttctattattttttattaattataccatgtcattaacaagtcatttgaatccatcgatagaaaaacatgtgggtatttattatgg
tacgttattatcggaacacttggtagttgaatctacctatagaaaaggagttcgaatagtcccattggatagtttttttgaaggatatcttagtgca
aaagtatacatgttagagaatattcaagttatgaaaatagcagctgatacgtcattaacttttattgggtattccgtatggatttggtcataatagaat
gtattgttttaaattggtagctgaatgttataaaaatgccggtattgatacatcgtctcaaacgaatattaggtaaagatattttctgagccaaaactt
cacagatgataatagatggataaagatatatgattctaataatttaacattttggcaaattgattaccttaaagggtgagttaatatgcataactact
cctccgttgtttttttccctcgttcttttttcttaacgttgtttgccatcactctcataatgtaaagatattctaaaatggtaaactttgcatatcggacgc
agaaattggtataaatgttgtaattgtattatttcccgtcaatggactagtcacagctccatcagtttatatccttttagagtatttctcactcgtgtct
aacattctagagcattccatgatctgtttatcgttgatattggccggaaagatagattttttattttttattatattactattggcaattgtagatataact
tctggtaaatattttctacctttttcaatctcttctatttttcaagccggctatatattctgctatattgttgctagtatcaataccttttctggctaagaagt
catatgtggtattcactatatcagtttttaactggtagttccattagcctttccacttctgcagaataatcagaaattggttctttaccagaaaatccag
ctactataataggctcaccgatgatcattggcaaaatcctatattgtaccagattaatgagagcatatttcatttccaataattctgctagttcttga
gacattgatttatttgatgaatctagttggttctctagatactctaccatttctgccgcatacaataacttgttagataaaatcagggttatcaaagtg
tttagcgtggctagaatagtgggcttgcatgtattaaagaatgcggtagtatgagtaaaccgtttaacgaattatatagtctccagaaatctgtg
gcgttacatacatgagccgaatgacatcgaagattgtccaatattttaatagctgctctttgtccattatttctatatttgactcgcaacaattgtag
ataccattaatcactgattcctttttcgatgccggacaatagcacaattgtttagcttggactctatgtattcagaattaatagatatatctctcaata
cagattgcactatacattttgaaactatgtcaaaaattgtagaacgacgctgttctgcagccatttaactttaaataatttacaaaaaatttaaaatga
gcatccgtataaaaatcgataaactgcgccaaattgtggcatattttttcagagttcagtgaagaagtatctataaatgtagactcgacggatga
gttaatgtatattttgccgcccttgggcggatctgtaaacatttgggccattatacctctcagtgcatcagtgttctaccgcggagccgaaaacat
tgtgtttaatcttcctgtgtccaaggtaaaatcgtgtttgtgtagttttcacaatgatgccatcatagatatagaacctgatctggaaaataatctag
taaaactttctagttatcatgtagtaagtgtcgattgtaacaaggaactgatgcctattaggacagatactactatttgtctaagtatagatcaaaa
gaaatcttacgtgtttaattttcacaagtatgaagaaaaatgttgtggtagaaccgtcattcatttagaatggttgttgggctttatcaagtgtatta
gtcagcatcagcatttggctattatgtttaaagatgacaatattattatgaagactcctggtaatactgatgcgttttccagggaatattctatgact

Fig. 58 (cont'd)

gaatgttctcaagaactacaaaagttttctttcaaaatagctatctcgtctctcaacaaactacgaggattcaaaaagagagtcaatgtttttgaa
actagaatcgtaatggataatgacgataacattctaggaatgttgttttcggatagagttcaatcctttaagatcaacatctttatgacgtttttagat
taatactttcaatgagataaatatgggtggcagagtaagtgttgagctccctaaacgggatccgcctccgggagtacccactgatgagatgtt
attaaacgtggataaaatgcatgacgtgatagctcccgctaagcttttagaatatgtgcataggaccactagcaaaagataaagaggataa
agtaaagaaaagatatccagagtttagattagtcaacacaggacccggtggtctttcggcattgttaagacaatcgtataatggaaccgcacc
caattgctgtcgcacttttaatcgtactcattattggaaaaaggatggaaagatatcagataagtatgaagagggtgcagtattagaatcgtgtt
ggccagacgttcacgacactggaaaatgcgatgttgatttattcgactggtgtcaggggggatacgttcgatagaaacatatgccatcagtgga
tcggttcagcctttaataggagtgatagaactgtagagggtcaacaatcgttaataaatctgtataataagatgcaaacattatgtagtaaagat
gctagtgtaccaatatgtgaatcattttgcatcatttacgcgcacacaatacagaagatagcaaagagatgatcgattatattctaagacaaca
gtctgcggactttaaacagaaatatgagatgtagttatcccactagagataagttagaagagtcattaaaatatgcggaacctcgagaatgt
tgggatccagagtgttcgaatgccaatgttaatttcttactaacacgtaattataataaatttaggactttgcaatattgtacgatgtaatactagcgt
gaacaacttacagatggataaaacttcctcattaagattgtcatgtggattaagcaatagtgatagattttctactgttcccgtcaatagagcaaa
agtagttcaacataatattaaacattcgttcgacctaaaattgcatttgatcagtttattatctctcttggtaatatggatactaattgtagctatttaaa
tgggtgccgcggcaagcatacagacgacggtgaatacactcagcgaacgtatctcgtctcaaattagaacaagaagcgaacgctagtgctc
aaacaaaatgtgatatagaaatcggaaattttttatatccgacaaaaccatggatgtaacctcactgttaaaaatatgtgctctgcggacgcgga
tgctcagttggatgctgtgttatcagccgctacagaaacatatagtggattaacaccggaacaaaaagcatacgtaccagctatgtttactgct
gcgttaaacattcagacgagtgtaaacactgttgttagagattttgaaaattatgtgaaacagacttgtaattctagcgcggtcgtcgataacaa
attaaagatacaaaacgtaatcatagatgaatgttacggagccccaggatctccaacaaatttggaatttattaatacaggatctagcaaagga
aattgtgccattaaagcgttgatgcaattgacgactaaggccactactcaaatagcacctagacaagttgctggtacaggagttcagttttatat
gattgttatcggtgttataatattggcagcgttgtttatgtactatgccaagcgtatgttgttcacatccaccaatgataaaatcaaacttattttagc
caataaggaaaacgtccattggactacttacatggacacattctttagaacttctccgatggttattgctaccacggatatgcaaaactgaaaat
atattgataatattttaatagattaacatggaagttatcgctgatcgtctagacgatatagtgaaacaaaatatagcggatgaaaaatttgtagatt
ttgttatacacggtctagagcatcaatgtcctgctatacttcgaccattaattaggttgtttattgatatactattatttgttatagtaatttatattttac
ggtacgtctagtaagtagaaattatcaaatgttgttggcgttggtggcgctagtcatcacattaactattttttattacttatactataatagtactag
actgacttctaacaaacatctcacctgccataaataaatgcttgatattaaagtcttctatttctaacactattccatctgtggaaaataatactctga
cattatcgctaattgacacatcggtgagtgatatgcctataaagtaataatcttctttgggcacatataccagtgtaccaggttctaacaacctatt
tactggtgctcctgtagcatactttttctttaccttgagaatatccatcgtttgcttggtcaatagcgatatgtgattttttatcaaccactcaaaaaag
taattggagtgttcatatcctctacgggctattgtctcatggccgtgtatgaaatttaagtaacacgactgtggtagatttgttctatagagccggt
tgccgcaaatagatagaactaccaatatgtctgtacaaatgttaaacattaattgattaacagaaaaaacaatgttcgttctgggaatagaaacc
agatcaaaacaaaattcgttagaatatatgccacgttatacatggaatataaaataactacagtttgaaaaataacagtatcatttaaacatttaa
cttgcggggttaatttcacaacatttactgtttttaaactgttcaaaaatatagcatcgatccatgagaaatacgtttagccgcctttaatagaggaaat
cccaccgccttctggatctcaccaacgacgatagttctgaccagcaacttatttcttcatcatccacctgtttaacatataataggcaggagat
agatatccgtcattgcaatattcctttcgtaggcacacaatctaatattgataaaatctccattctcttctctgcatttattatcttgtttcggtggctg
attaggctgtagtcttggtttaggctttggtatatcgttgttgaatctattttggtcattaaatctttcatttcttcctggtatatttctatcacctcgtttgg
ttggattttgtctatattatcgtttgtaacatcggtacgggtattcatttatcacaaaaaaaaacttctctaaatgagtctactgctagaaaacctcat
cgaagaagataccatattttttgcaggaagtatatctgagtatgatgatttacaaatggttattgccggcgcaaaatccaaatttccaagatctat
gctttctattttttaatatagtacctagaacgatgtcaaaatatgagttggagttgattcataacgagaatatcacaggggcaatgtttaccacaatg
tataatataagaaacaatttgggtctaggagatgataaactaactattgaagccattgaaaactatttcttggatcctaacaatgaggttatgcct
cttatcattaataatacggatatgactgccgtcattcctaaaaaaagtggtaggagaaagaataagaacatggttattttccgtcaaggatcatc
acctatcttgtgtattttcgaaactcgtaaaaagattaatatttataaagaaaatatggaatccgcgtcgactgagtatacacctatcggagacaa
caaggctttgatatctaaatatgcgggaattaatgtcctgaatgtgtattctccttccacatccatgagattgaatgccatttacggattcaccaat
aaaaataaactagagaaacttagtactaataaggaactagaatcgtatagttctagccctcttcaagaacccattaggttaaatgattttctggg
actattggaatgtgttaaaaagaatattcctctaacagatattccgacaaaggattgattactataaatggagaatgttcctaatgtatactttaatc
ctgtgtttatagagcccacgtttaaacattctttattaagtgtttataaacacagattaatagtttttatttgaagtattcattgtattcattctaatatatgt
attttttagatctgaattaaatatgttcttcatgcctaaacgaaaaatacccgatcctattgatagattacgacgtgctaatctagcgtgtgaagac

Fig. 58 (cont'd)

gataaattaatgatctatggattaccatggatgacaactcaaacatctgcgttatcaataaatagtaaaccgatagtgtataaagattgtgcaaa gcttttgcgatcaataaatggatcacaaccagtatctcttaacgatgttcttcgcagatgatgattcatttttttaagtatttggctagtcaagatgat gaatcttcattatctgatatattgcaaatcactcaatatctagacttctgttattattattgatccaatcaaaaaataaaattagaagccgtgggtcatt gttatgaatctctttcagaggaatacagacaattgacaaaattcacagactttcaagattttaaaaaactgtttaacaaggtccctattgttacaga tggaagggtcaaacttaataaaggatatttgttcgactttgtgattagtttgatgcgattcaaaaaagaatcctctctagctaccaccgcaataga tcctattagatacatagatcctcgtcgcgatatcgcattttctaacgtgatggatatattaaagtcgaataaagtgaacaataattaattctttattgt catcatgaacggcggacatattcagttgataatcggccccatgtttcaggtaaaagtacagaattaattagacgagttagacgttatcaaatag ctcaatataaatgcgtgactataaaatattctaacgataatagatacggaacgggactatggacgcatgataagaataattttgaagcattgga agcaactaaactatgtgatgtcttggaatcaattacagatttctccgtgataggtatcgatgaaggacagttctttccagacattgttgaattctgt gagcgtatggcaaacgaaggaaaaatagttatagtagccgcactcgatgggacatttcaacgtaaaccgtttaataatatttttgaatcttattcc attatctgaaatggtggtaaaactaactgctgtgtgtatgaaatgctttaaggaggcttccttttctaaacgattgggtgaggaaaccgagatag agataataggaggtaatgatatgtatcaatcggtgtgtagaaagtgttacgtcggctcataatatattatatttttttatctaaaaaactaaaaataaac attgattaaattttaatataatacttaaaaatggatgttgtgtcgttagataaaccgtttatgtattttgaggaaattgataatgagttagattacgaac cagaaagtgcaaatgaggtcgcaaaaaaactgccgtatcaaggacagttaaaactattactaggagaattattttttcttagtaagttacagcg acacggtatattagatggtgccaccgtagtgtatataggatctgctcccggtacacatatacgttatttgagagatcatttctataatttaggagtg atcatcaaatggatgctaattgacggccgccatcatgatcctattttaaatggattgcgtgatgtgactctagtgactcggttcgttgatgaggaa tatctacgatccatcaaaaaacaactgcatccttcaagattattttaatttctgatgtgagatccaaacgaggaggaaatgaacctagtacggc ggatttactaagtaattacgctctacaaaatgtcatgattagtattttaaaccccgtggcgtctagtcttaaatggagatgcccgtttccagatcaa tggatcaaggacttttatatcccacacggtaataaaatgttacaacctttttgctccttcatattcagctgaaatgagattattaagtatttataccggt gagaacatgagactgactcgagttaccaaatcagacgctgtaaattatgaaaaaaagatgtactaccttaataagatcgtccgtaacaaagta gttgttaactttgattatcctaatcaggaatatgactattttcacatgtactttatgctgaggaccgtgtactgcaataaaacatttcctactactaaa gcaaaggtactatttctacaacaatctatatttcgtttcttaaatattccaacaacatcaactgaaaaagttagtcatgaaccaatacaacgtaaaa tatctagcaaaaattctatgtctaaaaacagaaatagcaagagatccgtacgcagtaataaatagaaacgtactactgagatatactaccgata tagagtataatgatttagttactttaataaccgttagacataaaattgattctatgaaaactgtgtttcaggtatttaacgaatcatccataaattatac tccggttgatgatgattatggagaaccaatcattataacatcgtatcttcaaaaaggtcataacaagtttcctgtaaattttctatacatagatgtgg taatatctgacttatttcctagctttgttagactagatactacagaaactaatatagttaatagtgtactacaaacaggcgatggtaaaaagactct tcgtcttcccaaaatgttagagacggaaatagttgtcaagattctctaccgtcctaatataccattaaaaattgttagattttccgcaataacatg gtaactggagtagagatagccgatagatctgttatttcagtcgctgattaatcaattagtagagatgagataagaacattataataatcaataata tattttatatcttatatcttgtttagaaaaatgctaatattaaaaatagctaacgctagtaatccaatcggaagccatttgatatctataataggtatct aatttcctgattcagatagcggcagctatattctcggtagctactcgtttggaatcacaaacattatttacatctaatttactatctgtaatggaaa cgtttcccaatgaaatggtacaatccgatacattgcattttgttatatttttttttaaagaggctggtaacaacgcatcgcttcgtttacatggctcgt accaacaataataggggtaatcttgtatctattcctatccgtactatgctttttatcaggataaaatacatttacatcgtatatcgtctttgttagcatcaca gaatgcataaatttgttcgtccgtcatgataaaaatttaaagtgtaaatataactattattttatagttgtaataaaaagggaaatttgattgtatactt tcggttctttaaaagaaactgacttgataaaaatggctgtaatctctaaggttacgtatagtctatatgatcaaaaagagattaatgctacagatat tatcattagtcatgttaaaaatgacgacgatatcggtaccgttaaagatggtagactaggtgctatggatggggcattatgtaaaacttgtggga aaacggaattggaatgtttcggtcactggggtaaagtaagtatttataaaactcatatagttaagcctgaatttatttcagaaattattcgtttactg aattatatatgtattcactgcggattattgcgttcacgagaaccgtattccgacgatattaacctaaaagagttatcgggacacgctcttaggag attaaaggataaaatattatccaagaaaaagtcatgttggaacagtgaatgtatgcaaccgtatcaaaaaattacttttttcaaagaaaaaggttt gtttcgtcaacaagttggatgatattaacgttcctaattctctcatctatcaaaagttaatttctattcatgaaaagtttggccattattagaaattcat caatatccagctaacttattttatacagactactttcccatccctccgttgattattagaccggctattagtttttggatagatagtatacccaaaga aaccaatgaattaacttacttattaggtatgatcgttaagaattgtaacttgaatgctgatgaacaggttatccagaaggcggtaatagaatacg atgatattaaaattatttctaataacacttccagtatcaatttatcatatatcacatccggcaaaaataatatgattagaagttatatcgtcgcccgg cgaaaagatcagaccgctagatctgtaattggtcccagtacatctatcaccgttaatgaggtaggaatgcccgcatatattagaaatacactta cagaaaagatatttgttaatgcctttacagttggataaagttaaacaactattagcgtcaaaccaagttaaattttactttaataaacgattaaacca attaacaagaatacgccaaggaaagtttatcaaaaataaaaatacatttattgcctggtgattgggtagaagtagctgttcaagaatatacaagta

Fig. 58 (cont'd)

ttattttttggaagacagccgtctctacatagatacaacgtcatcgcttcatctatcagagctaccgaaggagatactatcaaaatatctcccgga
attgtcaactctcaaaatgctgatttcgacggagatgaagaatggatgatattggagcaaaatcctaaagccgtaattgaacaaagtattcttat
gtatccgacgacgttactcaaacacgatattcatggagcccccgtttatggatctattcaagatgaaatcgtagcagcgtattcattgtttaggat
acaagatctttgtttagatgaagtattgaacatcttggggaaatatggaagagagttcgatcctaaaggtaaatgtaaattcagcggtaaagata
tctatacttacttgataggtgaaaagattaattatccgggtctcttaaaggatggtgaaattattgcaaacgacgtagatagtaattttgttgtggct
atgaggcatctgtcattggctggactcttatccgatcataagtcgaacgtggaaggtatcaactttattatcaagtcatcttatgttttaagagata
tctatctatttacggttttggggtgacattcaaagatctgagaccaaattcgacgttcactaataaattggaggccatcaacgtagaaaaaatag
aacttatcaaagaagcatacgccaaatatctcaacgatgtaagagacgggaaaatagttccattatctaaagctttagaggcggactatgtgg
aatccatgttatccaacttgacaaatcttaatatccgagagatagaagaacatatgagacaaacgctgatagatgatccagataataacctcct
gaaaatggccaaagcgggttataaagtaaatcccacagaactaatgtatattctaggtacttatggacaacagaggattgatggtgaaccag
cagagactcgagtattgggtagagtcttaccttactatcttccagactctaaggatccagaaggaagaggttacattcttaattctttaacaaaa
ggattaacgggttctcaatattacttttcgatgctggttgcaagatctcaatctactgatatcgtctgtgaaacatcacgtaccggaacactggct
agaaaaatcattaaaaagatggaggatatggtggtcgacggatacggacaagtagttataggtaatacgctcatcaagtacgccgccaatta
taccaaaattctaggctcagtatgtaaacctgtagatcttatctatccagatgagtccatgacttggtatttggaaattagtgctctgtggaataaa
ataaaacagggattcgtttactctcagaaacagaaacttgcaaaaaagacattggcgccgtttaatttcctagtattcgtcaaacccaccactg
aggataatgctattaaggttaaggatctgtacgatatgattcataacgtcattgatgatgtgagagagaaatacttctttacggtatctaatataga
ttttatggagtatatattcttgacgcatcttaatccttctagaattagaattacaaaagaaacggctatcactatctttgaaaagttctatgaaaaact
caattatactctaggtggtggaactcctattggaattatttctgcacaggtattgtctgagaagttacacaacaagccctgtccagttttcacact
actgaaaaaagtggtgccgtcaaacaaaaacttggtttcaacgagtttaataacttgactaatttgagtaagaataagaccgaaattatcactct
ggtatccgatgatatctctaaacttcaatctgttaagattaatttcgaatttgtatgtttgggagaattaaatccaaacatcactcttcgaaaagaaa
cagataggtatgtagtagatataaatagtcaatagattatacatcaagagagcagaaattaccgaattagtcgtcgaatatatgattgaacgattc
atctcctttagcgtcattgtaaaggaatggggtatggaaacattcattgaggatgaggataatattagatttactgtctacctaaatttcgttgaac
cggaagaattgaatcttagtaagtttatgatggttcttccgggtgccgccaacaagggcaagattagtaaattcaagattcctatctctgattata
cgggatatgacgacttcaatcaaacaaaaaagctcaataagatgactgtagaactcatgaatctaaaagaattgggttctttcgatttggaaaa
cgtcaacgtgtatcctggagtatggaatacatacgatatcttcggtatcgaggccgctcgtgaatacttgtgcgaagccatgttaaacacctat
ggagaagggttcgattatctgtatcagccttgtgatcttctcgctagtttactatgtgctagttacgaaccagaatcagtgaataaattcaagttcg
gcgcagctagtactcttaagagagctacgttcggagacaataaagcattgttaaacgcggctcttcataaaaagtcagaacctattaacgata
atagtagctgccacttttttagcaaggtccctaatataggaactggatattacaaatacttatcgacttgggtcttctcatgagaatggaaagga
aactatctgataagatatcttctcaaaagatcaaggaaatggaagaaacagaagacttttaattcttatcaataacatattttctatgatctgtcttt
taaacgatggattttccacaaatgcgcctctcaagtccctcatagaatgatacacgtataaaaaatatagcataggcaatgactccttatttttag
acattagatatgccaaaatcatagccccgcttctatttactcccgcagcacaatgaaccaacacgggctcgtttcgttgatcacatttagataaa
aaggcggttacgtcgtcaaaatatttactaatatcggtagttgtatcatctaccaacggtatatgaataatattaatattagagttaggtaatgtata
tttatccatcgtcaaatttaaaacatatttgaacttaacttcagatgatggtgcatccatagcatttttataatttcccaaatacacattattggttactc
ttgtcattatagtgggagatttggctttgtgcatatctccagttgaacgtagtagtaagtatttatacaaactttcttatccatttataacgtacaaat
ggataaaactactttatcggtaaacgcgtgtaatttagaatacgttagagaaaaggctatagtaggcgtacaagcagccaaaacatcaacact
tatattctttgttattatattggcaattagtgcgctattactctggtttcagacgtctgataatccagtctttaatgaattaacgagatatatgcgaatta
aaaatacggtaacgattggaaatcattaacggatagcaaacaaaattagaaagtgatagaggtagacttctagccgctggtaaggatgat
atattcgaattcaaatgtgtggatttcggcgcctattttatagctatgcgattggataagaaacatatctgccgcaagctattaggcgaggtact
ggagacgcgtggatggttaaaaaggcggcaaaggtcgatccatctgctcaacaattttgtcagtatttgataaaacacaagtctaataatgtta
ttacttgtggtaatgagatgttaaatgaattaggttatagcggttatttttatgtcaccgcattggtgttccgatttagtaatatggaatagtgttagat
aaatgcggtaacgaatgttcctgtaaggaaccataacagcttagatttaacgttaaagatgagcataaacataatatacaaaattacaatcaaa
cctataacattaatatcaaacaatccaaaaaatgaaatcagtggagtagtaaacgcgtacataactcctggataacgtttagcagctgccgttc
ctattctagaccaaaaattcggtttcatgtttctgaaacggtattctgcaacaagtcgaggatcgtgttctacatatttggcggcgttatccagtat
ctgcctattgatcttcatttcgttttcgattctggctatttcaaaataaaatcccgatgatagacctccagactttataatttcatctacgatgttcagc
gccgtagtaactctaataatataggctgataagctaacatcataccctcctgtatatgtgaatatggcatgattttttgtccattacaagctcggtttt

Fig. 58 (cont'd)

aactttattgcctgtaataatttctctcatctgtaggatatctattttttttgtcatgcattgccttcaagacgggacgaagaaacgtaatatcctcaat
aacgttatcgttttctacaataactacatattctacctttttattttctaactcggtaaaaaaattagaatcccatagggctaaatgtctagcgatattt
cttttcgtttcctctgtacacatagtgttacaaaaccctgaaaagaagtgagtatacttgtcatcatttctaatgtttcctccagtccactgtataaac
gcataatccttgtaatgatctggatcatccttgactaccacaacatttctttttctggcataacttcattgtcctttacatcatcgaacttctgatcatt
aatatgctcatgaacattaggaaatgtttctgatggaggtctatcaataactggcacaacaataacaggagttttcaccgccgccatttagttatt
gaaattaatcatatacaactctttaatacgagttatattttcgtctatccattgtttcacatttacatatttcgacaaaaagatataaaatgcgtattcc
aatgcttctctgtttaatgaattactaaaatatacaaacacgtcactgtctggcaataaatgatatcttagaatattgtaacaatttattttgtattgca
catgttcgtgatctatgagttcttcttcgaatggcataggatctccgaatctgaaaacgtataaataggagttagaataataatatttgagagtatt
ggtaatatataaactctttagcggtataattagtttttttctctcgatttctattttttagatgtgatggaaaaatgactaattttgtagcattagtatcatg
aactctaatcgagatcttaatatcttcgtcacacgttagttctttgaagtttttaagagatgcatcagttggttcgaccgatggagtaggtgcaaca
attttttgttcgatgtatgtatgtactggagccattgtcttaactataatggtgcttgtatcgaaaaactttaatgcagataatggaagctcttcgccg
cgactttctacatcgtaattgggttctaacgccgatctctgaatggatactagttttctaagttctaatgtgattctctgaaaatgtaaatccaattcc
tccggcattatagatgtgtatacatcggtaaataaaactatagtatccaacgatcccttctcgcaaattctagtcttaaccaaaaaatcgtatataa
ccacggagatggcgtatttaagagtggattcttctaccgttttgttcttggatttcatataagaaactataaagtccgcactactgttaagaatgatt
actaacgcaactatatagtttaaattaagcatcttggaaacataaaataactctgtagacgatacttgactttcgaataagtttgcagacaaacga
agaaagaacagacctctcttaatttcagaagaaaactttttttcgtattcctgacgtctagagtttatatcaataagaaagttaagaattagtcggtt
aatgttgtatttcattacccaagtttgagatttcataatattatcaaaagacatgataatattaaagataaagcgctgactatgaacgaaatagctat
atggttcgctcaagaatatagtcttgttaaacgtggaaacgataactgtatttttaatcacgtcagcggcatctaaattaaatataggtatatttatt
ccacacactctacaatatgccacaccatcttcataataaataaaattcgttagcaaaattattaattttagtgaaatagttagcgtcaactttcatagc
ttccttcaatctaatttgatgctcacacggtgcgaattccactctaacatccctttttccatgcctcaggttcatcgatctctataatatctagtttttttg
cgtttcacaaacacaggctcgtctctcgcgatgagatctgtatagtaactatgtaaatgataactagatagaaagatgtagctatatagatgacg
atcctttaagagaggtatgatgactttaccccaatcagatagactgttgttatggtcttcggaaaaagaattttfatfaaattttfccagtattttccaa
atatacgtacttaacatctaaaaaatccttaatgataataggaatggataatccgtctattttataaagaaatacatatcgcacattatacttttttttg
gaaatgggaataccgatgtgtctacataaatatgcaaagtctaaatattttttagagaatcttagttggtccaaattcttttccaagtacggtaata
gatttttcatattgaacggtatcttcttaatctctggttctagttccgcattaaatgatgaaactaagtcactattttataactaacgattacatcacct
ctaacatcatcatttaccagaatactgatcttcttttgtcgtaaatacatgtctaatgtgttaaaaaaagatcatacaagttatacgtcatttcatct
gtggtattcttgtcattgaaggataaactcgtactaatctcttctttaacagcctgttcaaatttatatcctatatacgaaaaaatagcaaccagtgtt
tgatcatccgcgtcaatattctgttctatcgtagtgtataacaatcgtatatcttcttctgtgatagtcgatacgttataaaggttgataacgaaaata
tttttatttcgtgagataaagtcatcgtaggattttggacttatattcgcgtctagtagatatgctttattttttggaatgatctcaattagaatagtctct
ttagagtccatttaaagttacaaacaactaggaaattggtttatgatgtataattttttttagtttttatagattctttattctatacttaaaaaatgaaat
aaatacaaaggttcttgagggttgtgttaaattgaaagcgagaaataatcataaaattatttcattatcgcgatatccgttaagtttgtatcgtaatgg
cgtggtcaattacaaataaagcggatactagtagcttcacaaagatggctgaaatcagagctcatctaaaaaatagcgctgaaaataaagata
aaaacgaggatattttcccggaagatgtaataattccatctactaagcccaaaaccaaacgagccactactcctcgtaaaccagcggctacta
aaagatcaaccaaaaggaggaagtggaagaagaagtagttatagaggaatatcatcaaacaactgaaaaaaattctccatctcctggagt
cagcgacattgtagaaagcgtggctgctgtagagctcgatgatagcgacggggatgatgaacctatggtacaagttgaagctggtaaagta
aatcatagtgctagaagcgatctttctgacctaaaggtggctaccgacaatatcgttaaagatcttaagaaaattattactagaatctctgcagta
tcgacggttctagaggatgttcaagcagctggtatctctagacaatttacttctatgactaaagctattacaacactatctgatctagtcaccgag
ggaaaatctaaagttgttcgtaaaaaagttaaaacttgtaagaagtaaatgcgtgcacttttttataaagatggtaaactctttaccgataataattt
tttaaatcctgtatcagacgataatccagcgtatgaggttttgcaacatgttaaaattcctactcatttaacagatgtagtagtatatgaacaaacg
tgggaggaggcgttaactagattaattttttgtgggaagtgattcaaaaggacgtagacaatactttacggaaaaatgcatgtacagaatcgca
acgctaaaagagatcgtattttttgttagagtatataacgttatgaaacgaattaattgttttataaacaaaaatataaagaaatcgtccacagattc
caattatcagttggcggttttatgttaatggaaactatgttttttattagatttggtaaaatgaaatatcttaaggagaatgaaacagtaggggttatt
aacactaaaaaataaacacatagaaataagtcccgatgaaatagttatcaagtttgtaggaaaggacaaagtttcacatgaatttgttgttcata
agtctaatagactatataaaccgctattgaaactgacggatgattctagtcccgaagaatttctgttcaacaaactaagtgaacgaaaggtatac
gaatgtatcaaacagtttggtattagaatcaaggatctccgaacgtatggagtcaattatacgttttatataattttggacaaatgtaaagtccat

Fig. 58 (cont'd)

atctcctcttccgtcaccaaaaaagttaatagcgttaactatcaaacaaactgctgaagtggtaggtcatactccatcaatttcaaaaagagctt
atatggcaacgactattttagaaatggtaaaggataaaaaatttttagatgtagtatctaaaactacgttcgatgaattcctatctatagtcgtagat
cacgttaaatcatctacggatggatgatatagatctttacacaaataattacaagaccgataaatggaaatggataagcgtatgaaatctctcgc
aatgacagctttcttcggagagctaaacacattagatattatggcattgataatgtctatatttaaacgccatccaaacaataccatttttcagtg
gataaggatggtcagtttatgattgatttcgaatacgataattataaggcttctcaatatttggatctgaccctcactccgatatctggagatgaat
gcaagactcacgcatcgagtatagccgaacaattggcgtgtgtggatattattaaagaggatattagcgaatatatcaaaactactccccgtct
taaacgatttataaaaaaataccgcaatagatcagatactcgtatcagtcgagatacagaaaagcttaaaatagctctagctaaaggcatagat
tacgaatatataaaagacgcttgttaataagtaaatgaaaaaaaactagtcgtttataataaaacacaatatggatgccaacatagtatcatcttc
tactattgcaacgtatatagacgctttagcgaagaatgcttcagaattagaacagaggtctaccgcatacgaaataaataatgaattggaacta
gtatttattaagccgccattaattactttgacaaatgtagtgaatatctctacgattcaggaatcgtttattcgatttaccgttactaataaggaaggt
gttaaaattagaactaagattccattatctaaggtacatggtctagatgtaaaaaatgtacagttagtagatgctatagataacatagtttgggaa
aagaaatcattagtgacggaaaatcgtcttcacaaagaatgcttgttgagactatcgacagaggaacgtcatatattttggattacaagaaata
tggatcctctatccgactagaattagtcaatcttattcaagcaaaaacaaaaaactttacgatagactttaagctaaaatatttctaggatccggt
gcccagtctaaaagttctttattacacgctattaatcatccaaagtcaaggcctaatacatctctggaaatagaattcacacctagagacaatga
aaaagttccatatgatgaactaataaaggaattgacgactctatcacgtcatatatttatggcttctccagagaatgtaattctttctccgcctatta
acgcgcctataaaaaccttatgttgcctaaacaagatatagtaggtttggatctggaaaatctatatgccgtaactaagactgacggaattcct
ataactatcagagttacatcaaaagggttgtattgttattttacacatcttggttatattattagatatcctgttaagagaataatagattccgaagta
gtagtctttggtgaggcagttaaggataagaactggaccgtatatctcattaagctaatagagcctgtgaatgcaatcaatgatagactagaag
aaagtaagtatgttgaatctaaactagtggatatttgtgatcggatagtattcaagtcaaagaaatacgaaggtccgtttactacaactagtgaa
gtcgtcgatatgttatctacatatttaccaaagcaaccagaaggtgttattctgttctattcaaagggacctaaatctaacattgattttaaaattaa
aaaggaaaatactatagaccaaactgcaaatgtagtatttaggtacatgtccagtgaaccaattatctttggagaatcgtctatctttgtagagta
taagaaatttagcaacgataaaggctttcctaaagaatatggttctggtaagattgtgttatataacggcgttaattatctaaataatatctattgtt
ggaatatattaatacacataatgaagtgggtattaagtccgtggttgtacctattaagtttatagcagaattcttagttaatggagaaatacttaaa
cctagaattgataaaaccatgaaatatattaactcagaagattattatggaaatcaacataatatcatagtcgaacatttaagagatcaaagcatc
aaaataggagatatctttaacgaggatiaaactatcggatgtgggacatcaatacgccaataatgataaatttagattaaatccagaagttagtta
ttttacgaataaacgaactagaggaccgttgggaattttatcaaactacgtcaagactcttcttatttctatgtattgttccaaaacatttttagacga
ttccaacaaacgaaaggtattggcgattgattttggaaacggtgcggacctggaaaaatactttatggagagattgcgttattggtagcgacg
gatccggatgctgatgctatagctagaggaaatgaaagatacaacaaattaaactctggaattaaaaccaagtactacaaatttgactacattc
aggaaactattcgatccgatacatttgtctctagtgtcagagaagtattctattttggaaagtttaatatcatcgactggcagtttgctatccattatt
ctttcatccgagacattatgctaccgtcatgaataacttatccgaactaactgcttctggaggcaaggtattaatcactaccatggacggagac
aaaattatcaaaattaacagataaaaagactttaaataattcataagaatttacctagtagcgaaaactatatgtctgtagaaaaaatagctgatgata
gaatagtggtatataatccatcaacaatgtctactccaatgactgaatacattatcaaaaagaacgatatagtcagagtgtttaacgaatacgga
tttgttcttgtagataacgttgatttcgctacaattatagaacgaagtaaaaagtttattaatggcgcatctacaatggaagatagaccgtctacaa
aaaactttttcgaactaaatagaggagccattaaatgtgaaggtttagatgtcgaagacttacttagttactatgttgtttatgtcttttctaagcggt
aaataataatatggtatgggttctgatatccccgttctaaatgcattaaataattccaatagagcgattttttgttcctataggaccttccaactgtgg
atactctgtattgttaatagatatattaatactttgtcgggtaacagaggttctacgtcttctaaaaataaaagtttgataacatctggcctgttcata
aataaaaacttggcgattctatatatactcttattatcaaatctagccattgtcttatagatgtgagctactgtaggtgtaccatttgattttctttctaa
tactatatatttctctcgaagaagttcttgcacatcatctgggaataaaatactactgttgagtaaatcagttattttttttatatcgatattgatggac
attttatagttaaggataataagtatcccaaagtcgataacgacgataacgaagtatttatactttaggaaatcacaatgactttatcagatcaa
aattaacaaaattaaaggagcatgtatttttttctgaatatattgtgactccagatacatatggatctttatgcgtcgaattaaatgggtctagttttc
agcacggtggtagatatatagaggtggaggaatttatagatgctggaagacaagttagatggtgttctacatccaatcatatatctgaagatat
gcacactgataaatttgtcatttatgatatttatacgtttgattcgttcaagaataaacgattggtatttgtacaggtgcctccatcattaggagatg
atagctatttgactaatccgttattgtctccgtattatcgtaattcagtagccagacaaatggtcaatgatatgattttttaatcaagattcattttaaa
atatttattagaacatctgattagaagccactatagagtttctaaacatataacaatagttagatacaaggataccgaagaattaaatctaacgag
aatatgttataatagagataagtttaaggcgtttgtattcgcttggtttaacggccgtttcggaaaatgaaaaggtactagatacgtataaaaaggt

Fig. 58 (cont'd)

atctaatttgatataatgaattcagtgactgtatcacacgcgccatatactattacttatcacgatgattgggaaccagtaatgagtcaattggtag
agttttataacgaagtagccagttggctgctacgagacgagacgtcgcctattcctgataagttctttatacagttgaaacaaccgcttagaaat
aaacgagtatgtgtgtgtggtatagatccgtatccgaaagatggaactggtgtaccgttcgaatcaccaaattttacaaaaaaatcaattaagg
agatagcttcatctatatctagattaaccggagtaattgattataaaggttataaccttaatataatagacggggttataccctggaattattactta
agttgtaaattaggagaaacaaaaagtcacgcgatctactgggataagatttccaagttactgctgcagcatataactaaacacgttagtgttct
ttattgtttgggtaaaacagatttctcgaatatacgggcaaagttagaatccccggtaactaccatagtcggatatcatccagcggctagagac
cgccaattcgagaaagatagatcatttgaaattatcaacgttttactggaattagacaacaaggcacctataaatttgggctcaagggtttatttat
taatgctttagtgaaattttaacttgtgttctaaatggatgcaactattagaggtaatgatgttatctttgttcttaagactataggtgtcccgtcagc
gtgcagacaaaatgaagatccaagatttgtagaagcatttaaatgcgacgagttagaaagatatattgagaataatccagaatgtacactattc
gaaagtcttagggatgaggaagcatactctatagtcagaattttcatggatgtagatttagacgcgtgtctagacgaaatagattatttaacggc
tattcaagattttattatcgaggtgtcaaactgtgtagctagattcgcgtttacagaatgcggtgccattcatgaaaatgtaataaaatccatgag
atctaattttcattgactaagtctacaaatagagataaaacaagttttcatattatctttttagacacgtataccactatggatacattgatagctatg
aaacgaacactattagaattaagtagatcatctgaaaatccactaaccagatcgatagacactgccgtatataggagaaaaacaactcttcgg
gttgtaggtactaggaaaaatccaaattgcgacactattcatgtaatgcaaccaccgcatgataatatagaagattacctattcacttacgtgga
tatgaacaacaatagttattactttctctacaacgacgattggaggatttagttcctgataagttatgggaaccagggtttatttcattcgaagac
gctataaaaagagtttcaaaaatattcattaattctataataaactttaatgatctcgatgaaaataattttacaacggtaccactggtcatagatta
cgtaacaccttgtgcattatgtaaaaaacgatcgcataaacatccgcatcaactatcgttggaaatggtgctattagaatttacaaaactggta
atccacatagttgtaaagttaaaattgttccgttggatggtaataaactgtttaatattgcacaaagaattttagacactaactctgttttattaaccg
aacgaggagaccatatagtttggattaataattcatggaaatttaacagcgaagaacccttgataacaaaactaattctgtcaataagacatca
actacctaaggaatattcaagcgaattactctgtccgaggaaacgaaagactgtagaagctaacatacgagacatgttaatagattcagtgga
gaccgatacctatccggataaacttccgtttaaaaatggtgtattggacctggtagacggaatgtttactctggagatgatgctaaaaaatata
cgtgtactgtatcaaccggatttaaatttgacgatacaaagttcgtcgaagacagtccagaaatggaagagttaatgaatatcattaacgatatc
caaccattaacggatgaaaataagaaaaatagagagttgtacgaaaaaactttatctagttgtttatgcggtgctaccaaaggatgtttaacatt
ctttttggagaaactgcaactggaaagtcgacaaccaaacgtttgttaaagtctgctatcggtgacctgtttgttgagacgggtcaaacaatttt
aacagatgtattggataaaggacctaatccatttatcgctaacatgcatttgaaaagatctgtattctgtagcgaactacctgattttgcctgtagt
ggatcaaagaaaattagatctgacaatattaaaaagttgacagaaccttgtgtcattggaagaccgtgtttctccaataaaattaataatagaaa
ccatgcgacaatcattatcgatactaattacaaacctgtctttgataggatagataacgcattaatgagaagaattgccgtcgtgcgattcagaa
cacactttctcaaccttctggtagagaggctgctgaaaataatgacgcgtacgataaagtcaaactattagacgaggggttagatggtaaaat
acaaaataatagatatagattcgcatttctatacttgttggtgaaatggtacaaaaaatatcatgttcctattatgaaactatatcctacaccggaa
gagattccggactttgcattctatctcaaaataggtactctgttagtatctagctctgtaaagcatattccattaatgacggacctctccaaaaag
ggatatatattgtacgataatgtggttactcttccgttgactactttccaacagaaaatatccaagtattttaattctagactatttggacacgatata
gagagcttcatcaatagacataagaaatttgccaatgttagtgatgaatatctgcaatatatattcatagaggatatttcatctccgtaaatatatg
ctcatatatttatagaagatatcacatatctaaatgaataccggaatcatagatttatttgataatcatgttgatagtataccaactatattacctcatc
agttagctactctagattatctagttagaactatcatagatgagaacagaagcgtgttattgttccatattatgggatcaggtaaaacaataatcg
ctttgttgttcgccttggtagcttccagatttaaaaaggtttacattctagtgcctaatattaacattttgaaaatttttaattataatatgggtgtagct
atgaacttgtttaatgacgaattcatagctgagaatatctttattcattccacaacaagtttttattctcttaattataacgataacgtcattaattataa
cggattatctcgctacaataactctattttatcgttgatgaggcacataatatctttgggaataatactggagaacttatgaccgtgataaaaaat
aaaaacaagattccttttttactattgtctggatctcccattactaacacacctaatactctgggtcatattatagatttaatgtccgaagagacgat
agattttggtgaaattattagtcgtggtaagaaagtaattcagacacttcttaacgaacgaggtgtgaatgtacttaaggatttgcttaaaggaag
aatatcatattacgaaatgcctgataaagatctaccaacgataagatatcacggacgtaagtttctagatactagagtagtatattgtcacatgtc
taaacttcaagagagagattatgattactagacgacagctatgttatcatgaaatgtttgataaaaatatgtataacgtgtcaatggcagtattg
ggacaacttaatctgatgaataatttagatactttatttcaggaacaggataaggaattgtacccaaatctgaaaataaataatggcgtgttatac
ggagaagaattggtaacgttaaacattagttccaaatttaaatacttattaatcggatacagacactcaacggaaaacattttatatactttctaa
ttctacatatggcggattggtaattaaatatatcatgctcagtaatggatattctgaatataatggttctcagggaactaatccacatatgataaac
ggcaaaccaaaaacatttgctatcgttactagtaaaatgaaatcgtctttagaggatctattagatgtgtataattctcctgaaaacgatgatggc

Fig. 58 (cont'd)

agtcaattgatgttttttgttttcgtcaaacattatgtccgaatcctatactctgaaagaggtaaggcatatttggtttatgactatcccagatacttttt ctcaatacaaccaaattcttggacgatctattagaaaattctcttacgccgatatttctgaaccagttaatgtatatctttagccgccgtatattcc gatttcaatgacgaagtgacgtcattaaacgattacacacaggatgaattaattaatgtttttaccatttgacatcaaaaagctgttgtatctaaaat ttaagactaaagaaacgaatagaatatactctattcttcaagagatgtctgaaacgtattctcttccaccacatccatcaattgtaaaagtttttattg ggagaattggtcagacaatttttttataataattctcgtattaagtataacgataccaagttacttaaaatggttacatcagttataaaaaataaaga agacgctaggaattacatagatgatattgtaaacggtcacttctttgtatcgaataaagtatttgataaatctcttttatacaaatacgaaaacgat attattacagtaccgtttagacttcctacgaaccatttgtttggggagttaactttcgtaaagaatataacgtggtatcttctccataaaactgatg agatatataaagaaataaatgtcgagctttgttaccaatggataccttccagttacattggagccacacgagctgacgttagacataaaaacta atattaggaatgccgtatataagacgtatctccatagagaaattagtggtaaaatggccaagaaaatagaaattcgtgaagacgtggaattac ctctcggcgaaatagttaataattctgtagttataaacgttccgtgtgtaataacctacgcgtattatcacgttggggatatagtcagaggaacat taaacatcgaagatgaatcaaatgtaactattcaatgtggagatttaatctgtaaactaagtagagattcgggtactgtatcatttagcgattcaa agtactgctttttttcgaaatggtaatgcgtatgacaatggcagcgaagtcactgccgttctaatggaggctcaacaaggtatcgaatctagtttt gtttttctcgcgaatatcgttgactcataaaaaagagaatagcggtaagtataaacacgaatactatggcaataattgcgaatgtttattcccttc gatatattttgataatatgaaaaacatgtctctctcaaatcggacaaccatctcataaaatagttctcgcgcgctggagaggtagttgctgctcg tataatctccccagaataaatacttgcgtgtcgtcgttcaatttatacggatttctatagttctctgttatataatgcggttttccatcatgattagac gacgacaatagtgttctaaatttagatagttgatcagaatgaatgtttattggcgttggaaaaattatccatacagcgtctgcagagtggttgata gttgttcctagatatgtaaaataatccaacttactaggcagcaaattgtctagataaaatactgaatcaaacggtgcagacgtattggtggatct aatggaatccaattgattaactatcttttgaaaatatacattttttatgatccgatacttgtaagaatatagaaataatgataagtccatcatcgtgtttt tttgcctcttcataagaactatatttttttcttattccaatgaacaagattaatctctccagagtatttgtacacatctatcaagtgattggatccataatc gtcttcctttccccaatatatacgtagtgatgataacacacatattcattgggggagaaaccctccacttatatatcctcctttaaaattaatccttactag ttttccagtgttctggatagtggttggtttcgactcattataatgtatgtctaacggcttcaatcgcgcgttagaaattgctttttttagtttctatattaat aggagatagttgttgcggcatagtaaaaatgaaatgataactgtttaaaaatagctcttagtatgggaattacaatggatgaggaagtgatattt gaaactcctagagaattaatatctattaaacgaataaaagatattccaagatcaaaagacacgcatgtgtttgctgcgtgtataacaagtgacg gatatccgttaataggagctagaagaacttcattcgcattccaagcgatattatctcaacaaaattcagattctatcttagagtatccactaaact attacggtttatgtactacaatgaactaagagaaatctttagacggttgagaaaaggttctatcaacgatatcgatcctcactttgaagagttaat attattgggtggtaaactagataaaaaggaatctattaaagattgtttaagaagagaattaaaagaggaaagtgatgaacgtataacagtaaaa gaatttggaaatgtaattctaaaacttacaacacgggataaattatttaataaagtatatataagttattgcatggcgtgtttattaatcaatcgttg gaggatttatcgcatactagtatttacaatgtagaaattagaaagattaaatcattaaatgattgtattaacgacgataaatacgaatatctgtctta tatttataatatgctagttaatagtaaatgaacttttacagatctagtataattagtcagattattaagtataatagacgactagctaagtctattatttg cgaggatgactctcaaattattacactcacggcattcgttaaccaatgcctatggtgtcataaacgagtatccgtgtccgctattttattaactact gataacaaaatattagtatgtaacagacgagatagttttctctattctgaaataattagaactagaaacatgtctagaaagaaacgattatttctga attattccaattatttgtccaaacaggaaagaagtatactatcgtcattttttttctctagatccagctactactgataatgatagaatagatgctattta tccgggtggcatacccaaaaggggtgagaatgttccagagtgtttatccagggaaattaaagaagaagttaatatagacaattcttttgtattca tagacactcggtttttttattcatggcatcatagaagataccattattaataaaattttttgaggtaatcttctttgtcggaagaatatctttaacgagtga tcaaatcattgatacatttaaaagtaatcatgaaatcaaggatctaatattttttagatccgaattcaggtaatggactccaatacgaaattgcaaaa tatgctctagatactgcaaaactcaaatgttatggccatagaggatgttattacgaatcattaaaaaaattaactgaggatgattgattagaaaat ataaattaatttaccatcgtgtattttataacgggattgtccggcatatcatgtagatagttaccgtctacatcgtatactcgaccatctacgccttt aaatcctctatttattgacattaatctattagaattggaataccaaatattagtaccctcaattagtttattggtaatattttttttagacgatagatcgat ggctcttgaaaccaaggttttccaaccggactcattgtcgatcggtgagaagtctttttcattagcatgaatccattctaatgatgtatgtttaaac actctaaacaattggacaaattcttttgatttgctttgaatgatttcaaataggtcttcgtctacagtaggcataccattagataatctagccattata aagtgcacgtttacatatctacgttctggaggagtaagaacgtgactattgagacgaatggctcttcctactatctgacgaagagacgcctcgt tccatgtcatatctaaaatgaagatatcattaattgagaaaaaactaatacccctcgcctccactagaagagaatacgcatgttttaatgcattctc cgttagtgtttgattcttggttaaactcagccaccgccttgattctagtatcttttgttctagatgagaactctatattagagataccaaagactttga aatatagtaataagatttctattcctgactgattaacaaatggttcaaagactagacatttaccatgggatgctaatattcccaaacatacatctat aaatttgacgcttttctcttttaattcagtaaatagagagatatcagccgcactagcatcccctttcaatagttctccctttttaaaggtatctaatgc

Fig. 58 (cont'd)

ggatttagaaaactctctatctcttaatgaattttttaaaatcattatatagtgttgctatctcttgcgcgtattcgcccggatcacgattttgtctttcag
gaaagctatcgaacgtaaacgtagtagccatacgtctcagaattctaaatgatgatatacctgtttttatttcagcgagtttagccttttgataaatt
tcttcttgcttttcgacatattaacgtatcgcattaatactgttttcttagcgaatgatgcagacccttctacgtcatcaaaaatagaaaactcgttat
taactatgtacgaacataggcctcctagtttggagactaattctttctcatcaactagacgtttattctcaaatagcgattggtgttgtaaggatcct
ggtcgtagtaagttaaccaacatggtgaattcttgcacactattaacgataggtgtagccgataaacaaatcatcttatggtttttaatgcgatg
gtcttagataaaaaattatatactgaacgagtaggacggatcttaccatcttctttgattaatgatttagaaatgaagttatgacattcatcaataat
gacgcatattctactcttggaattaatagttttgatattagtaaaaaatttatttctaaaattttgatcatcgtaattaataaaaatacaatccttcgttat
ctctggagcgtatctgagtatagtgttcatccaaggatcttctatcaaagcctttttcaccaataagataatagcccaattcgtataaatatccttaa
gatgtttgagaatatatacagtagtcattgtttaccaacacccgtttcatggaacaataaaagagaatgcatactgtctaatcctaagaaaactc
ttgctacaaaatgttgataatccttgaggcgtactacgtctgttcccatcatttcaacaggcatattagtagttctgcgcaatgcataatcgatata
ggccgcgtgtgatttactcatttatgagtgataagtaataactatgtttaaaaatcacagcagtagtttaactagtcttctctgatgtttgttttcgat
acttttgaatcagaagtcatactagaataaagcaacgagtgaacgtaatagagagcttcgtatactctattcgaaaactctaagaacttattaat
gaattccgtatccactggattgtttaaaatactaaattgaacactgttcacatccttccaagaagaagacttagtgacggacttaacatgagaca
taaataaatccaaattttttttacaaacatcactagccaccataatggcgctatctttcaaccagctatcgcttacgcattttagcagtctaacatttt
taaagagactacaatatattctcatagtatcgattacacctctaccgaataaagttggaagtttaataatacaatattttttcgtttacaaaatcaaat
aatggtcgaaacacgtcgaaggttaacatcttataatcgctaatgtatagattgtttcagtgagatgattattagatttaatagcatctcgttcacg
tttgaacagtttattgtgtgcgctgaggtcggcaactacggcgtccgctttagtactcctcccataatactttacgctattaatctttaaaatttcata
gactttatctagatcgctttctggtaacatgatatcatgtgtaaaaagttttaacatgtcggtcggcattctatttagatcattaactctagaaatctg
aagaaagtaattagctccgtattccagactaggtaatgggctttttacctaaagacaagttaagttctggcaatgtttcataaaatggaagaagg
acatgcgttccctcccggatatttttacaatttcatccatttacaactctatagtttgttttcattattattagttattatctcccataatcttggtaatact
taccccttgatcgtaagataccttatacaggtcattacatacaactaccaattgtttttgtacataatagattggatggttgacatccatggtggaat
aaactactcgaacagatagtttatctttcccccctagatacattggccgtaatagttgtcggcctaaagaatatctttggtgtaaagttaaaagttag
ggttcttgttccattattgctttttgtcagtagttcattataaattctcgagatgggtccgttctctgaatatagaacatcatttccaaatctaacttcta
gtctagaaataatatcggtcttattcttaaaatctattcccttgatgaagggatcgttaatgaacaaatccttggcctttgattcggctgatctattat
ctccgttatagacgttacgttgactagtccaaagacttacaggaatagatgtatcgatgatgttgatactatgtgatatgtgagcaaagattgttct
cttagtggcatcactatatgttccagtaatggcggaaaacttttttagaaatgttatatataaaagaattttttcgtgttccaaacattagcagattagt
atgaagataaacactcatattatcaggaacattatcaattttacatacacatcagcatcttgaatagaaacgataccatcttctggaacctcaac
aatctcggcagactccggataaccagtcggtgggccatcactaacaataactagatcatccaacaatctactcacatatgcatctatataatctt
tttcatcttgtgagtaccctggatacgaaataaatttattatccgtatttccataataaggtttagtataaacagagagcgatgttgccgcatgaac
ttcagttacagtcgccgttggttggtttatttgacctattactctcctaggtttctctataaacgatggtttaatttgtacattcttaaccatatatccaat
aaagctcaattcaggaacataaacaaattctttgttgaacgtttcaaagtcgaacgaagagtcacgaataacgatatcggatactggattgaag
gttaccgttacggtaattttttgaatcggatagtttaagactgctgaatgtatcttccacatcaaacggagttttaatataaacgtatactgtagatgg
ttctttaatagtgtcattaggagttaggccaatagaaatatcattaagttcactagaatatccagagtgtttcaaagcaattgtattattgatacaatt
attatataattcttcgccctcaatttcccaaataacaccgttacacgaagagatagatacgtgattaatacatttatatccaacatatggtacgtaa
ccgaatcttcccataccctttaacttctggaagtccaaactcagaaccaaatgattaagcgcagtaatatactgatccctaatttcgaagctagc
gatagcctgattgtctggaccatcgtttgtcataactccggatagagaaatatattgcggcatatacaaagttggaatttgactatcgactgcga
agacattagaccgtttaatagagtcatccccaccgatcaaagaattaatgatagtattattcattttctatttaaaatggaaaaagcttacaataaa
ctccgtagagaaatatctataatttgtgagttttccttaaagtaacagcttccgtaaacgccgtctttatctcttagtaggtttattgtatttatgacctt
ttccttatcttcatagaatactaaaggcaacaaagaaattttggttcttctctaagagctacgtgagacttaaccatagaagccaacgaatccct
acatatttagaacagaaatacccaacttcaccacccttgaatgtctcaatactaataggtctaaaaaccaaatcttgattacaaaaccaacactt
atcaattacactatttgtcttaatagacacatctgccatagatttataatactttggtagtatacaagcgagtgcttcttcttagcgggcttaaaga
ctgctttaggtgctgaaataaccacatctggaaggcttactcgcttagccatttaattacggaactatttttttatacttctaatgagcaagtagaaa
acctctcatctacaaaaacatactcgtgtccataatcctctaccatagttacacgtttttttagatctcatatgtgctaaaaagtttttcccatactaatt
ggttactattattttttcgtataattttttaacagtttgaggtttttagattttttagttacagaagtgatatcgaatatttatccaaaaagaatgaataattaa
ttgtcttagaaggagtgtttttcttggcaaaagaataccaagtgcttaaatatttctactacttcattaatctttttctgtactcagattcagtttctcatctt

Fig. 58 (cont'd)

ttacttgattgattatttcaaagactaacttataatcctttttatttattctctcgttagccttaagaaaactagatacaaaatttgcatctacatcatccg
tggatatttgatttttttccatgatatccaagagttccgagataatttctccagaacattgatgagacaataatctccgcaatacatttctcaaatga
ataagtttattagacacatggaagtttgactttttttgtacctttgtacattttgaaatacagactcgcaaaaaatacaatattcatatccttgttcag
atactataccgttgtgtctacaaccgctacataatcgtagattcatgttaacactctacgtatctcgtcgtccaatattttatataaaaacattttattt
ctagacgttgccagaaaatcctgtaatattttagtttttgggctgtgaataaagtatcgccctaatatggttaccgtcctccgccaatatagtagt
taaattatccgcacatgcagaagaacaccgcttaggcggattcagtacaatgttatattttcgtaccaactcatttaaatatcataatctaaaata
gttctgtaatatgtctagcgctaatatattgatcataatcctgtgcataaattaagatacaacaatgtctcgaaatcatcgacatggcttcttccata
gttagaagatcgtcgtcaaagttagcaacgtgattcatcaacatttgctgttttgaggcagcaaatactgaaccgtcgccattcaaccattcata
aaaaccatcgtctgaatccattgataatttcttgtactggttttttgagagctcgcatcaatctagcatttctagctcccggattgaaaacagaaag
aggatcgtacatccagggtccattttctgtaaatagaatcgtataatgtcccttcaagaagatatcagacgatccacaatcaaagaattggtctc
cgagtttgtaacaaactgcggactttaacctatacatgataccgtttagcatgatttctggtgatacgtcaatcggagtatcatctattagagatct
aaagccggtgtaacattctccaccaaacatattcttattctgacgtcgttctacataaaacatcattgctccattaacgataacaggggaatgaa
cagcactacccatcacattagttcccaatggatcaatgtgtgtaactccagaacatcttccatatcctatgttaggaggagcgaacaccactctt
ccactattgccatcgaatgccatagaataaatatccttggaattgatagaaatcggactgtcggatgttgtgatcatcttcataggattaacaact
atgtatggtgccgcctgaagtttcatatcgtaactgatgccgtttataggtctagccacagaaaccaacgtaggtctaaatccaactatagaca
aaatagaagccaatatctgttcttcatctgtcataacttgagagcatccagtatgaataatcttcattagatggggatctaccgcatcatcatcgtt
acaataaaaaattcccattctaatgttcataattgcttttctaatcatggtatgcatgtttgctctctgaatctctgtggaaattagatctgatacacct
gtaatcactatcggattatcctccgtaagacgattaaccaacaacatataattataagactttacttttctaaattcataaagttgctggattaggct
ataggtgtctccatgtacatacgcgttctcgagcgcaggaagtttaataccgaatagtgccatcagaataggatgaatatagtaattagtttctg
gtttttctataaataaaagacaaatcttgtgaactagacatatcggtaaaatgcatggattggaatcgtgtagtcgacagaagaatatgatgatta
gatggagagtatattttatctaactctttgagttggtcaccgattctaggactagctcgagaatgaataagtactaaaggatgagtacatttcaca
gaaacactagcattgttcaatgtgctctttacatgggtaaggagttgaaatagctcgtttctatttgttctgacaatatttagtttattcataatgttaa
gcatatcctgaatagtaaagttagatgtgtcatacttgttagtagttagatatttagcaattgcattcccatcatttctcaatctcgtactccaatcat
gcgtggatgctacttcgtcgatggaaaccatacaatccttttgataggctgttgagattgattatttcctgcacgtttaggtttggtacgttgatttc
tagcccctgcggatataaagtcatcgtctacaattttggataatgaattgcatacactacaagacaaagatttatcagaagtgtgaatatgatctt
catctaccaaagaaagagtttgattagtataactagatttagtcctgcgttagatgttaaaaaaacatcgctattgaccacggcttccattatttat
attcgtagttttactcgaaagcgtgatttaatattcaatcttattacttttggaatcgttcaaaacctttgactaattgtagaatttgatctattgccct
acgcgtatactcccttgcatcatatacgttcgtcaccagatcgtttgtttcggcctgaagttggtgcatatctctttcaacattcgacatgagatcc
ttaagggccatatcgtctagattttgttgagatgctgctcctggatttggattttgttgtgctgttgtacatactgtaccaccagtaggtgtaggagt
acatacagtggccacaataggaggttgaggaggtgtaaccgttggagtagtacaagaaatacttccatccgattgttgtgtacatgtagttgtt
ggtaacgtctgagaaggttgggtagatggcggcgtcgtcgtcttttgatctttattaaatttagagataatatcctgaacagcattgctcggcgtc
aacgctggaaggagtgaactcgccggcgcatcagtatctgcagacagccaatcaaaaagattagacatatcagatgatgtattagtttgttgt
cgtggttttggtgtaggagccggtgtagctgttggaaccggctgtggagttatatgaatagttggttgtagcggttggataggctgtctgctgg
cggccatcatattatctctagctagttgttctcgcaactgtctttgataatacgactcttgagactttagtcctatttcaatcgcttcatccttttcgta
tccggatcctttcttcagaataatagattgacgactttggtgtagaggattctgccagccccgtgtgagaacttgttaaagaagtccatttaaggc
tttaaaattgaattgcgattataagattaaatggcagacacagacgatattatcgactatgaatccgatgatctcaccgaatacgaggatgatga
agaagaggaagaagatggagagtcactagaaactagtgatatagatcccaaatcttcttataagattgtagaatcagcatccactcatataga
agatgcgcattccaatcttaaacatataggaatcatatatctgctcttaaacgacgctatactagacgtataagtctatttgaaatagcgggtat
aatagcagaaagctataacttgcttcaacgaggaagattacctctagtttcagaatttctgacgaaacgatgaagcaaaatatgctacatgtaa
ttatacaagagatagaggagggttcttgtcctatagtcatcgaaaagaacggagaattgttgtcggtaaacgatttttgacaaagatggtctaaa
attccatctagactatattatcaaaatttggaaacttcaaaaacgatattagaatttatacgaatatcgttctctaaatgtcacaatcaagtctcgca
tgttcagcaatttattgtcgtactttatatcgtgttcattaacgatatcttgcaaaatagtaatgattctatcttccttcgatagatattcttcagagatta
ttgtcttatattctttcttgttatcagatatgaatttgataagactttgaacattattgatacccgtctgtttaatttttctacagatattttagttttggcag
attctatcgtatctgtcaatagacatccaacatcgacattcgacgtcaattgtctataaatcaacgtataaatttagaaataacattagcgaattgt
tgtgcattgatgtcgttattctgaaacagtatgattttaggtagcattttcttaacaaagagaacgtatttattgttactcagttgaacagatgatatat

Fig. 58 (cont'd)

ccagattactaacgcatctgattccatataccaaactttcagaagaaatggtgtacaattgtttgtattcattcaatgtctcttttcagaaattagttt
agagtcgaatactgcaataattttcaagagatagttttcatcagataagattttatttagtgtagatatgataaaactattgttttgttggagaacttg
atacgccgcgttctctgtagtcgacgctctcaaatgggaaacaatctccattattttttggaatcggatacaatatcttcggtatcttgacgcaat
ctagtatacatagagttaagagaaattagagtttgtacattaagcaacatgtctctaaatgtggctgcaaacttttccttttccacatcatctagttta
ttatataccgatttcacaacggcaccagatttaaggaaccagaatgaaaaactctgataactacaatatttcatcatagttacgattttatcatcttc
tatagttggtgtaatagcgcataccttttctccaagactggaaccaacgtcataaaaatgtttaaatcaaaatccatatcaacatctgatgcgct
aagaccagtctcgcgttcaagattatctttactaatggtgacgaactcatcgtatagaactctaagtttgtccattatttatttacagatttagttgttt
aatttatttgtgctcttccagagttgggatagtattttctaacgtcggtattatattattaggatctacgttcatatgtatcataatattaatcatccac
gttttgataaatctatctttagcttctgaaataacgtatttaaacaaaggagaaaaatatttagctacggcatcagacgcaataacatttttgtaaa
tgtaacgtatttagacgacagatcttcgttaaaaagttttccatctatgtagaatccatcggttgttaacaccattcccgcgtcagattgaatagga
gtttgaatagtttgtttttggaaatagatccttcaataacttatagttgggtgggaaaaaatcgattttatcactagactctttcttttttactatcattac
ctcatgaactatttcttgaatgagtatatgtattttctttcctatatcggacgcgttcattggaaaatataccatgtcgttaactataagaatattttat
cctcgtttacaaactgaataatatcagatgtagttcgtaaacgaactatatcatcaccagcacaacatctaactatatgatatccactagtttccttt
agtcgtttattatcttgttccatattagcagtcattccatcatttaagaaggcgtcaaagataataggggagaaatgacattttggattctgttacaac
tttaccaaaattaaggatatacggacttactatctttttctcaacgtcgatttgatgaacacacgatgaaaatgtacttcgatgagattgatcatgta
gaaaacaacaagggatacaatatttccacatatcatgaaatatattaagaaatcccaccttattatatttccccaaaggatccatgcatgtaaac
attatgccgttatcattaataaagacttctttctcatcggatctgtaaaagttgttactgatttttttcattccaggatctagataattaataatgatggg
ttttctattcttattctttgtattttggcatatcctagaccagtaaacagtttccactttggtaaaatcagcagactttgaacgctattaaacatggcat
taatggcaataactaaaaatgtaaaatattttctatgttaggaatatggttttcactttaatagatatatggttttttggccaaaatgatagatattttt
tatccgaggatagtaaaatattattagtcgccgtctctataaaaatgaagctagtctcgatatccaatttattctagaattgataggagtcgccaa
atgtaccttatacgttatatctcccttgatgcgttccatttgtgtatctatatcggacacaagatctgtaaatagttttacgttattaatcatcacggta
tcgccgtcgctagataacgctaatgtaccatccaagtcccaaatggagagatttaactgttcatcgtttagaataaaatgattaccggtcatatta
ataaagtgttcatcgtatctagataacaacgacttataattaatgtccaagtcttgaactcgctgaatgatcttttttaacccagttagtttttagattg
gtacgaaatatattgttaaactttgattctacagtaatgtccaaatctagttgtggaaatacttccatcaacattgtttcaaacttgataatattattat
ctacatcttcatacgatccaaattccggaatagatgtatcgcacgctctggccacccagataaccaaaaagtcacacgctccaggatatacat
tgtataaaaagctatcgttttttagtagtgtttttttctgagtatatacgaagggattaaaaatagtattatcaacgtaactatattccaaattattcttat
gagaatagataataatatcgtccttaatatctaacaaatttcctaaatatccctttaattgagtcattcgaagcgtcaatagaatatgtctcttaacta
tttccggctgttgtatatttaaatgacttcgtaaaaaataatatatgggcgacttctcatctatgtaatcatatggagtgagatatagggctcgttct
acctcctgcccccttacccacctgtaataccaattgcggacttactatatatcgcatatttatatcgtggggtaaagtgaaaatctactaccgatga
tgtaagtcttacaatgttcgaaccagtaccagatcttaatttggaggcctccgtagaactaggggaggtaaatatagatcaaacaacacctatg
ataaaggaaaatagcggttttatatcccgtagtagacgtctattcgcccatagatctaaggatgatgagagaaaactagcactacgattctttt
acaaagactttattttttagatcatagagagattcattatttgttcagatgcgttgacgctgtaaaagacgtcactattaccaaaaaaaataacatta
tcgtggcgccttatatagcacttttaactatcgcatcaaaaggatgcaaacttacagaaacaatgattgaagcattcttccagaactatataatg
aacatagtaagaaatttaaattcaactctcaagtatccatcatccaagaaaaactcggataccagtttggaaactatcacgtttatgattttgaac
cgtattactctacagtagctctggctattcgagatgaacattcatctggcatttttaatatccgtcaagagagttatctggtaagttcattatctgaa
ataacatatagattttatctaattaatctaaaatctgatcttgttcaatggagtgctagtacgggcgctgtaattaatcaaatggtaaatactgtattg
attacagtgtatgaaaagttacaactggtcatagaaaatgattcacaatttacatgttcattggctgtggaatcaaaacttccaataaaattactta
aagatagaaatgaattatttacaaaattcatcaacgagttaaaaaagaccagttcattcaagataagcaaacgcgataaggatacgctactaa
aatattttacttaggactggagttagaatttatagacgactcatttcgtttatcattattagtattcttcttgttatcttgttcagaaatatacagcaatgc
tatgcctaatactaaatacattatcatgcttgcaatggctctaacaacgacgaaccaaaatgaatttggtcgtagcttttgttcacaaaaatacata
aagaaatgtctacataaatctatggcgccattggctacttgaaatagcgccagtcctcctacagatttaatatagctgtataacatgacatttatt
catcatcaaaagagacagagtcaccatctgtcatatttagattttttttcatgtgttcaaagtatcctctactcatttcattataatagtttatcatactt
agaattttaggacggatcaatgagtaagacttgactagatcgtcagtagtaatttgtgcatcgtctattctgcatccgcttcgtcgaataatgtata
gcatcgctttgagattctccatagctatcaagtctttatacaatgacatggaaatatctgtgaatactttatacttctccaacatcgatgccttaaca
tcatcgcctactttagcattgaaaatacgttctattgtgtagatggatgtagcaagattttaaacaacaatgccattttacacgatgattgcctcaa

Fig. 58 (cont'd)

gtctccaatcgtttgtttagaacgattagctacagagtccaatgcttggctgactagcatattattatctttagaaattgtattcttcaatgaggcgtt
tatcatatctgtgatttcgttagtcatattacagtctgactgggttgtaatgttatccaacatatcacctatggatacggtacacgtaccagcatttgt
aataatcctatctaagatgttgtatggcattgcgcagaaaatatcttctcctgtaatatttccactctcgataaatctactcagattattcttaaatgc
cttattctctggagaaaagatatcagtgtccatcatttcattaatagtatacgcagaaaagataccacgagtatcaattctatccaagatacttatc
ggttccgagtcacagataatggtttcctctccttcgggagatcctgcatagaaatatctaggacaatagtttctatactgtctgtaactctgataat
ctctaaagtcactaactgataccatgaaattgagaagatcaaacgctgaagtaattaattttctgcctcgtttttactacaactagttttcatcaat
gtagtgacgatgtattgtttagttactcttggtctaatactgatgatagagatattattacttcccataatggatcttctagtagtcaccttaaagccc
attgatgcaaatagcagatagataaagtcttggtatgactcctttctaatatagtacggactacctttgtcacccaactttatacccacataagcc
ataacaacctctttaatagccgttcatgaggtttatcagccatgagcctgagtagttggaagaatctcatgaatcctgtctcagaaagtcctata
tgcatgatagatttatctttcctgggaaactctcgtatagtcatagatgaaatactcttcaaagtttctgaaataagattagtaacagtcttacctcc
gactactctaggtaacaaacaaactctaataggtgtttctctgcggagataaatcagaaaggatagagcaataagtagtattattgtgattata
aagaccgaatacataacaggtagaatttataaacatcatgtcctgaaggtttttagacttgtattcctcgtaatccataccgtcccaaaacatgga
tttggtaactttgatagccgtagatctttgttccttcgccaacaggttaaagaaattaataaagaatttgtggtttctacctatgtctacaaattgcac
gtttggaagcgccacggttacattcactgcagcattttgaggatcgcgagtatgaagtacgatgttattgtttactggtatatctggaaagaattc
taccagtctaggaataagagattgatatcgcatagaaatacaaaagttcataatctcatcatctaagagcattttgttaccattgtaataaatatcc
actctgtcatatgtataaatgaagtactgttcaaacatgatgagatgtttatatgttggcatagtagtgagatctacgtttggtaatggcaatgtatt
aagattaactccataatgtctagcagcatctgcgatgttataagcgttgtcaaagcggggtcgatcttgtgctgttatatattgtctaacacctata
agattatcaaaatcttgtctgcttaatacaccgttaacaattttgccttgaattctttattggtgcattaataacatccttatagaggatgttaaaca
aataagtgttatcaaagttaagatctggatatttcttttctgctagaacatccattgagtcggagccatctggtttaatataaccaccgataaatcta
gctctgtattctgtatccgtcaatctaatattaagaaggtgttgagtgaaaggtggaagatcgtaaaagctgtgagtattaatgataggattagttt
ccgaactaatgttaattggggtattaataatatctatatttccagcgttaagtgtaacattaaacagttttaattcacgtgacgtggtatcaattaaat
aattaatgcccaatttggatatagcagcctgaagctcatcttgtttagttacggatcctaatgagttattaagcaatatatcgaacggatgaacga
aggttgtttaagttggtcacatactttgtaatctagacatagatgcggaagaacggtagaaactatacgaataaatattcagagtcctctaatt
gatcaagagtaactattgacttaataggcatcatttatttagtattaaatgacgaccgtaccagtgacggatatacaaaacgatttaattacagag
ttttcagaagataattatccatctaacaaaaattatgaaataactcttcgtcaaatgtctattctaactcacgttaacaacgtggtagatagagaac
ataatgccgccgtagtgtcatctccagaggaaatatcctcacaacttaatgaagatctatttccagatgatgattctccggccactattatcgaa
cgagtacaacctcatactactattattgacgatactccacctcctacgtttcgtagagagttattgatatcggaacaacgtcaacaacgagaaa
aaagatttaatattacagtatcgaaaaatgctgaagcaataatggaatctagatctatgatatcttctatgccaacacaaacaccatccttggga
gtagtttatgataaagataaaagaattcagatgttggaggatgaagtggttaatcttagaaatcaacgatctaatacaaaatcatctgataattta
gataattttaccagaatactatttggtaagactccgtataaatcaacagaagttaataagcgtatagccatcgttaattatgcaaatttgaacggg
tctcccttatcagtcgaggacttggatgtttgttcagaggatgaaatagatagaatctataaaacgattaaacaatatcacgaaagtagaaaac
gaaaaattatcgtcactaacgtgattattattgtcataaatattatcgagcaagcattgctaaaactcggatttgaagaaatcaaaggactgagta
ccgatatcacttcagaaattatcgatgtggagatcggagatgactgcgatgctgtagcatcaaaactaggaatcggtaacagtccggttctta
atattgtattgtttatactcaagatattcgttaaacgaattaaaattatttaatttaatacattcccatatccagacaacaatcgtctggattaatctgtt
cctgtcgtctcataccggacgacatattaatctttttattagtaggcatcttttagatggtttctttttcccagcattaactgagtcgatacctagaa
gatcgtgattgatctctccgaccattccacgaacttctaattggccgtctctgacggtaccataaactatttaccagcattagtaacagcttgga
caatctgaccatccatcgcattgtacgatgtagtagtaactgttgttctacgtctaggagcaccagaagtattttggagcccttggatgttgatg
tagaagaagacgaggattttgattttggtttacatgtaatacattttgtatcacatgcgccggcagtcacatctgtttgagaattaagattattgttg
cctcctttgacggctgcatctccaccgatttgcgctagtagattttaagctgtggtgtaatcttattaactgtttcgatataatcatcgtaactgctt
ctaacggctaaatttttttatccgccatttagaagctaaaaatattttatttatgcagaagatttaactagattatacaatgaactaatatgatcctt
tccagattatttacaaacttggtattttttggttctggaggaggcgaatttaaattcggacttggatttggattttgtgggttcttgatcttattataca
gcgcatataggatggcgacggtaactgctacgcaaataccgatcaacaaaagaataccaatcatttattgacaataacttcactattgatcaag
tatgcaatatatcatcttttcactaaataagtagtaataatgattcaacaatgtcgagatatatggacgataataatttagttcatggaaatatcgct
atgattggtatgaatgactccgctaactctgtggggcgcgcagtgctttccccacatagaataaattagcattccgactgtgataataataccaa
gtataaacgccataatactcaatactttccatgtacgagtgggactggtagacttactaaagtcaataaaggcgaagatacacgaaagaatca

Fig. 58 (cont'd)

aaagaatgattccagcgattagcacgccggaaaaataatttccaatcataagcatcatatccatttaactaataaaaattttaaatcgccgaatg
aacaaagtggaatataaaccatataaaaacaatagtttgtactgcaaaaataatatctattttgtttcgaagatatggtaaaattaaatagtagta
cacagcatgttataactaacagcagcaacggctcgtaattacttatcatttactagacgaaaaggtggtgggdatattttcttgctcaaataatacg
aatatatcacccatccattttatgcgatgtttatatactctaatctttaatagatctatagacgacgggtttaccaacaatatagattttatcgattcat
ctaatttaaacccttccttaaacgtgaatgatctattatctggcataacgatgactctacccgatgaatcggacaatgtactgggccatgtagaat
aaattatcaacgaattatcgtctacgaacatttatatcatttgtttaattttagtacgcgaataaatagatataaaatagaaaataacagatattaca
accaatgttatggccgcgcccaaccaggtaggcagttttattttatcttttactacaggttctcctggatgtacgtcaccaacggcggacgtagt
tctagtacaattagacgtaagttccgcttgggaatttttaacgctaaagagttaacgttaatcgtgcacccaacgtatttacatctagttctttgaa
catcttgattataatataaccattttctatctctagattcgtcggtgcactcatgtaaccaacataccctaggtcctaaatatttatctccggaattag
attttggataattcgcgcaccaacaatttctatttcctttatgatcgttacaaaagacgtataatgccgtatccccaaaagtaaaataatcaggac
gaataattctaataaactcagaacaatatctcgcatccatatgtttggagcaaatatcggaataagtagacatagccggtttccgttttgcacgta
accattctaaacaattgggggtttccaggatcgtttctacaaaatccagtcatgaaatcatcacaatgttctgtcttgtaattattattaaatattttgg
acagtgtttggtatttgtcttagaacaacattttgccacgctatcactatcgcccaggagataatcctttttttataaaatgacatcgttgcccggat
gctatataatcagtagcgtgttttaaatccttaatatattcaggagttacctcgttctgataatagattaatgatccaggacgaaatttgaaagaact
acatggttctccatgaattaatacatattgtttagcaaattcaggaactataaaactactacaatgatctatcgacataccatctatcaaacaaaac
ttgggtttaatttctcccggagatgtttcataatagtacgtataactttcttctgcaaacttaacagctctattatattcaggataattaaaacctaatt
ccatatatttgtctcgtatatctgctattcctggtgctattttgattctattaagagtaacggctgcccccatttttaataatcgtcagtatttaaactgtt
aaatgttggtatatcaacatttaccttatttcccgcagtataaggtttgttgcaggtatactgttcaggaatggttacatttatactttttctatagtcct
gtctttcgatgttcatcacatatgcaaagaacagaatataacaaaataatgtaagaaataatattaaatatctgtgaattcgtaaatacattgattgc
cataataattacagcagctacaatacatacaatagacattcccacagtgttgccattacctccacgatacatttgagttactaagcaataggtaat
aactaagctagtaagaggcaatagaaaagatgagataaatatcatcaatatagagattagaggagggctatatagagccaagacgaacaaa
atcaaaccgagtaacgttctaacatcattattttgaagattcccaaataatcattcattcctccataatcgttttgcatcatacctccatctttaggc
ataaacgattgctgctgttcctctgtaaataaatctttatcaagcactccagcacccgcagagaagtcgtcaagcatattgtaatatcttaaataa
ctcatttatatattaaaaaatgtcactattaaagatggagtataatctttatgccgaactaaaaaaaatgacttgtggtcaacccctaagtctttttaa
cgaagacggggatttcgtagaagttgaaccgggatcatcctttaagtttctgatacctaagggattttacgcctctccttccgtaaagacgagtc
tagtatttgaaacattaacaacgaccgataataaaattactagtatcaatccaacaaatgcgccaaagttatatcctcttcaacgcaaagtcgtat
ctgaagtagtttctaatatgaggaaaatgatcgaatcaaaacgtcctctatacatcactcttcacttggcgtgtggatttggtaagactattacca
cgtgttatcttatggctacacacggtagaaaaaccgtcatttgcgtacccaataaaatgttaatacatcaatggaagacacaggtagaggcag
tcggattggaacataagatatccatagatggagtaagtagtctattaaaggaactaaagactcaaagtccggatgtattaatagtagtcagtag
acatctgacaaacgatgccttttgtaaatatatcaataagcattatgatttgttcatcttggatgaatcacatacgtataatctgatgaacaatacag
cagttacaagattttagcgtattatcctccgatgatgtgttatttttaactgctacacctagaccatctaacagaatttattgtaacagtattattaat
attgccaagttatccgatctaaaaaaaactatctatgcagtagatagtttttttgagccatattccacagataatattagacatatgataaaacgatt
agatggaccatctaataaaatcatatatataccgagaagtattatctgtagacgagcctagaaatcaacttattcttaatacctggtagaaga
attcaagtcaggaactattaatcgcattttagttattactaaactacgtgaacatatggtattcttctacaaacgattattagatttttcggatcaga
ggttgtatttataggagacgcccaaaatagacgtactccagatatggtcaaatcaatcaaggaactaaatagatttatattcgtatccaccttattt
tattccggtactggtttagatattcctagtttggattctttgttcatttgctcggcagtaatcaacaatatgcaaatagagcaattactagggagggt
atgtcgagaaacagaactattagataggacggtatatgtatttcctagcacatccatcaaagaaataaagtacatgataggaaatttcgttcaac
gaattattagtctgtctgtagataaactaggatttaaacaaaaaagttatcggaaacatcaagaatccgatcccacttctgtatgtacaacatcct
ccagagaagaacgtgtattaaatagaatatttaactcgcaaaatcgttaagaagtttaagcgacgatccgcatgctgcgcaggccagtgtatt
acccctcatagtattaatataatccaatgatactttgtgatgtcggaaatcttaaccaatttagactgacaggcagaacacgtcatgcaatcatc
atcgtcatcgataactgtagtcttgggcttctttttgcggctcttcattccggaacgcacattggtgctatccatttaggtagtaaaaaataagtca
gaatatgccctatagcacgatcgtgcaaaacctggtatatcgtctctatctttatcacaatatagtgtatcgacatctttattattattgacctcgttt
atcttggaacatggaatgggaacattttgttatcaacggccacctttgccttaattccagatgttgtaaaattataactaaacagtctatcatcga
cacaaatgaaattcttgtttagacgtttgtagttacgtatgcggctcgttcgcgtctcattttttcagatattgcaggtactataatattaaaaataa
gaatgaaataacataggattaaaaataaagttatcatgacttctagcgctgatttaactaacttaaaagaattacttagtctgtacaaaagtttgaa

Fig. 58 (cont'd)

attttcagattctgcggctatagaaaagtataattctttggtagaatgggggaacatctacttactggaaaataggcgtgcaaaaggtagctaatg tcgagacgtcaatatctgattattatgatgaggtaaaaaataaaccgtttaatattgatccgggctattacattttcttaccggtatattttgggagc gtctttatttattcgaagggtaaaaatatggtagaacttggatctggaaactcttttcaaataccagatgatatgcgaagtgcgtgtaacaaagta ttagacagcgataacggaatagactttctgagatttgttttgttaaacaatagatggataatggaagatgctatatcaaaatatcagtctccagtta atatatttaaactagctagtgagtacggattaaacatacccaaatatttagaaattgaaatagaggaagacacattatttgacgacgagttatact ctattatagaacgctctttcgatgataaatttccaaaaatatccatatcgtatattaagttgggagaacttaggcggcaagttgtagactttttcaaa ttctcattcatgtatattgagtccatcaaggtagatcgtataggagataatattttattcctagcgttataacaaaatcaggaaaaaagatattagt aaaagatgtagaccatttaatacgatccaaggttagagaacatacatttgtaaaagtaaaaaagaaaaacacattttccattttatacgactatg atggaaacggaacagaaactagaggagaagtaataaaacgaattatagacactataggacgagactattatgttaacggaaagtatttctcta aggttggtagtgcaggcttaaagcaattgactaataaattagatattaatgagtgcgcaactgtcgatgagttagttgatgagattaataaatcc ggaactgtaaaacgaaaaataaaaaaccaatcagcatttgatttaagcagagaatgtttgggatatccagaagcggattttataacgttagtta ataacatgcggttcaaaatagaaaattgtaaggttgtaaatttcaatattgaaaatactaattgtttaaataacccgagtattgagactatatatgg aaactttaaccagttcgtctcaatctttaatatcgtcaccgatgtcaaaaaaagattattcgagtgaaataatatgcgcctttgatataggtgcaaa aaatcctgccagaactgttttagaagtcaaggataactccgttagggtattggatatatcaaaattagactggagttctgattgggaaaggcac atagctaaagatttgtcacaatatgaatacactacagttcttctagaacgtcagcctagaaggtcgccgtacgtcaaatttatctattttattaaag gcttttatatcatacatcggctgccaaagttatttgcgtctcgcctgtcatgtctggtaattcatatagagatcgaaaaaagagatcggtcgaag catttcttgattggatggacacattcggattgcgagactccgttccggatagacgcaaattagacgatgtagcggatagtttcaatttggctatg agatacgtattagataaatggaatactaattatacaccttataataggtgtaaatctagaaattacataaaaaaaatgtaataacgttagtaacgc cattatggataatctatttacctttctacatgaaatagaagatagatatgccagaactattttaactttcatctaataagttgcgatgaaataggag atatatatggtcttatgaaagaacgcatttcctcagaggatatgtttgataatatagtgtataataaagatatacatcatgccattaagaaactagt gtattgcgacatccaacttactaaacacattattaatcagaatacgtatccggtatttaacgattcttcacaagtgaaatgttgtcattatttcgatat aaactcagataatagcaatattagctctcgtacagtagagatatttgagagggaaaagtcatctcttgtatcatatattaaaactaccaataagaa gagaaaggtcaattatgggggaaataaagaaaactgtacatggaggcactaatgcaaattacttttccggtaaaaagtctgatgagtatctgag cactacagtcaggtccaacattaatcaaccttggatcaaaaccatttctaagagaatgagagtagatatcattaatcactctatagtaacgcgtg gaaaaagctctatattacaaactatagaaattattttactaatagaacatgtgtgaaaatattcaaggattctactatgcacattattctatccaag gacaaggatgaaaaggggtgtatacacatgattgacaaattattctatgtctattataattatttctgttgttcgaggatatcatccaaaacgagt actttaaagaagtagctaatgttgtaaaccacgtactcacggctacggcattagatgagaaattattcctaattaagaaaatggctgaacacga tgtttatggagttagcaatttcaaaataggggatgtttaacctgacattattaagtcgttggatcataccgttttcccctctctgttagatgaggatag caaaataaagttttttaaggggaaaaagctcaatattgtagcattacgatctctggaggattgtataaattacgtgactaaatccgagaatatgat agaaatgatgaaggaaagatcgactattttaaatagcatagatatagaaacggaatcggtagatcgtctaaaagaattgcttctaaaatgaaaa aaaaacactaattcagaaatggatcaacgactcggatataagttttggtgcctgatcctaaagccggagtttttatagaccgttacatttccaa tatgtatcgtattctaatttatattgcatcgattgcatgaaatcttgaccgtcaagcggccactcttatcgttaagaataatacagaacgaattat gatagaaattagcaatgttaaagtgactcctccagattactcacctataatcgcgagtattaaaggtaagagttatgacgcattagccacgttca ctgtaaatatctttaaagaggtaatgaccaaagagggtatatccatcactaaaataagtagttatgagggaaaagattctcatttgataaaaattc cgctactaataggatacgggaataaaaatccacttgatacagccaagtatcttgttcctaatgtcataggtggagtctttatcaataaacaatctg tcgaaaaagtaggaattaatctagtagaaaagattacaacatggccaaaatttaggggttgttaagccaaactcattcactttctcgttttcctccgt atcccctcctaatgtattaccgacaagatatcgccattacaagatatctctggatatatcacaattggaagcgttgaatatatcatcgacaaaga catttataacggtcaatattgttttgctgtctcaatatttatctagagtgagtctagaattcattagacgtagtttatcatacgatatgcctccagaag ttgtctatctagtaaacgcgataatagatagtgctaaacgaattactgaatctattactgactttaatattgatacatacattaatgacctggtggaa gctgaacacattaaacaaaatctcagttaacgatcaacgagttcaaatatgaaatgctgcataactttttacctcatatgaactatacacccgat caactaaagggattttatatgatatctttactaagaaagtttctctactgtatctaccacacttctagatatccagatagagattcgatggtttgtcat cgcatcctaacgtacggcaaatattttgagacgttggcacatgatgaattagagaattacataggcaacatccgaaacgatatcatgaacaat cacaagaacagaggcacttacgcggtaaacattcatgtactaacaactcctggacttaatcatgcattttctagtctattgagtggaaagttcaa aaagtcagacggtagttatcgaacacatcctcactattcatggatgcagaatatttctattcctaggagtgttggatttttatccggatcaagtaaa gatttcaaagatgtttctgtcagaaaataccatccaagtcaatatctttactttttgttcatcggacgttccggaaagaggtcctcaggtaggttta

Fig. 58 (cont'd)

gtatctcaattgtctgtcttgagttccattacaaatatactaacgtctgagtatttggatttggaaaagaaaatttgtgagtatatcagatcatattat aaagatgatataagttactttgaaacaggatttccaatcactatagaaaatgctctagtcgcatctcttaatccaaatatgatatgtgattttgtaac tgactttagacgtagaaaacggatgggattcttcggtaacttggaggtaggtattactttagttagggatcacatgaatgaaattcgcattaatat tggagcgggaagattagtcagaccattcttggttgtggataacggagagctcatgatggatgtgtgtccggagttagaaagcagattagacg acatgacattctctgacattcagaaagagtttccgcatgtcatcgaaatggtagatatagaacaatttacttttagtaacgtatgtgaatcggttca aaaatttagaatgatgtcaaaggatgaaagaaagcaatacgatttatgtgactttcctgccgaatttagagatggatatgtagcatcttcactagt gggaatcaatcacaattctggacccagagctattcttggatgtgctcaagctaaacaagctatctcttgtctgagctcggatatacgaaataaa atagacaatggaattcatttgatgtatccagagaggccaatcgtgattagtaaggctttagaaacttcaaagattgcggctaattgcttcggcca acatgttactatagcattaatgtcgtacaaaggtatcaatcaagaggatggaattatcatcaaaaaacaatttattcagagaggcggtctcgata ttgttacagccaagaaacatcaagtagaaattccgttggaaaactttaataacaaagaaagagataggtctaacgcctattcaaaattagaaag taatggattagttagactgaatgcttcttggaatccggagacgctatagcacgaaatatctcatcaagaactcttgaagatgattttgctagaga taatcagattagctttgatgtttccgaaaaatataccgatatgtacaaatctcgcgttgaacgagtacaagtagaacttactgacaaagttaaggt acgagtattaaccatgaaagaaagaagacccattctaggagacaaatttaccactagaacgagtcaaaagggaacagtcgcgtatatcgcg gatgaaacggaacttccatacgatgaaaatggtatcacaccagatgtcattattaattctacatccatcttctctagaaaaactatatctatgttga tagaggttattttaacagccgcatattctgctaagccgtacaacaataagggagaaaaccgacctgtctgttttcctagtagtaacgaaacatc catcgatacatatgcaattcgctaaacaatgttatgagcattcaaatccgaaattgtctgatgaagaattatcggataaaatcttttgtgaaaag attctctatgatcctgaaacggataagccttatgcatccaaagtatttttggaccaattattacttgcgtctgaggcatttaactcaggacaagg caaccgttagatgtagaggtaaaaagacgaagctcattagacaggcgaatgagggacgaaaacgtggaggaggtatcaagttcggagaa atggagagagactgtttaatagcgcatggtgcagccaatactattacagaagtttttgaaagattcggaagaagattatcaagatgtgtatgtttg tgaaaattgtggagacatagcagcacaaatcaagggtattaatacatgtcttagatgttcaaaacttaatctctctcctctcttaacaaaaattgat accacgcacgtatctaaagtatttcttactcaaatgaacgccagaggcgtaaaagttaaattagatttcgaacgaaggcctccttcgttttataa accattagataaagttgatctcaaaccgtctttctggtgtaatattctagtttggtagtagatacatatcaatatcatcaaattcgagatccgaatta taaaatgggcgtggattgttaactatagaatcggacgtctgatattcgaaaatctgtggagttttaggttttggtggaggtgtaactgctacttgg gatactgaagtctgatattcagaaagctgggggatgttctggttcgacatccaccgatggtgtcacatcactaatcggttcggtaacgtctgtg gacgatggaggcaccacttctacaggttctggttctttatcctcagtcatcaacggagctacttcaatgcgaggaaatgtataatttggtaatgg tttctcatgtggatctgaagaagaggtaagatatctactagaaagataccgatcacgttctagttctcttttgtagaacttaactttttctttctccgc atctagttgatattccaacctcttcacgttcgcatgggttacctccgcagtttttacgagcgatttcacgttcagccttcatgcgtcttatagcatga attcgcttatcgttatcgggtttagcttctgtcaccttagcaattcctttttattaaactctacataatcatatccatttctattgtttgttctaatataaac gagtatagcatcattgctaaatttttcaatagtatcgaaaacagaatatcctaaaccatataatatatattcaggaacactcaaactaaatgtcca ggattctcctaaatacgtaaactttaatagtgcgaaatcattcaaaaatctaccacttatagatagatagatagtacataaatgcgtatagtagtct acctatctctttattatgaaaaccggcattacgatcatatatgtcgtgatatacctgtgatccgtttacgttaaaccataaatacatgggtgatccta taaacatgaatttatttctaattctcagagctatagttaattgaccgtgtaatatttgcttacatgcatacttgatacgatcattaataagatttttatcat tgctcgttatttcagaatcgtatatataaggagtaccatcgtgattcttaccagatattatacaaaatactatatataaaatatattgacccacgtta gtaatcatgtaaatgtttaacgttttaaattttgtattcaatgatccattatcatacgctagcatggtcttatgatattcattctttaaaatataatattgtg ttagccattgcattggggctcctaatggagattttttattctcatccattttaggataggctttcataaagtccctaataacttcgtgaataatgtttct atgttttctactgatgcatgtatttgcttcgattttttttatcccatgtttcatctatcatagatttaaacgcagtaatgctcgcaacattaacatcttgaa ccgttggtacaattccgttccataaatttataatgttcgccatttatataactcatttttgaatatactttaattaacaaaagagttaagttactcatat ggacgccgtccagtctgaacatcaatcttttagccagagatatcatagccgctcttagagtttcagcgtgatttccaacctaaatagaacttca tcgttgcgtttacaacacttttctatttgttcaaactttgttgttacattagtaatcttttttttccaaattagttagccgttgtttgagagtttcctcattgtc gtcttcatcggctttaacaattgcttcgcgtttagcctctggcttttttagcagccgttgtagaaaaaaattcagttgctggaattgcaagatcgtca tctccggggaaaagagttccgtccatttaaagtacagatttagaaactgacactctgcgttatttatatttggtacaacacatggattataaatatt gatgttaataacatcagaaaatgtaaagtctatacattgttgcatcgtgttaaattttctaatggatctagtattattgggtccaacttctgcctgaaa tccaaatatggaagcggatacaaaaccgtttcctggataaaccacacatctccacttttgctttacatcagaaattgtgtcgttgacatcttgaac tctcctatctaatgccggtgttccacctatagattttgaatattcgaatgctgcatgagtagcattaaattccttaatattgccataattttcatatattg agtaaccctggataaaaagtaaacacaccgcagccgtagctaccacaataaaaaaaattgatagagagttcatttataatctattagaagctg

Fig. 58 (cont'd)

acaaaattttttacacgcatcagacaatgctttaataaatagttcaacatctacttttgtcatatcgaaccgatggtatgattctaacctagaattac
atccgaaaaagttgactatgttcatagtcattaagtcattaacaaacaacattccagactctggattataagacgatactgtttcgtcacaattacc
taccttaatcatgtgattatgaatattggctattagagcaccttctaagaaatctataatatctttgaaacacgatttaaaatcaaaccacgaatata
cttctacgaagaaagttagtttacccataggagaaataactataaatggagatctaaatacaaaatccggatctatgatagtttaacattattata
ttctctattaaatacctccacatctaaaaatgttaattttgaaactatgtcttcgtttattaccgtacctgaactaaacgctataagctctattgtttgag
aactctttaaacgatattcttgaaatacatgtaacaaagtttcctttaactcggtcggtttatctaccatagttacagaatttgtatccttatctataata
taataatcaaaatcgtataaagttatataattatcgcgttcagattgggatctttcaaatagactaaaaaccccatttctctagtaagtatcttatgt
atatgtttgtaaaatatcttcatggtgggaatatgctctaccgcagttagccattcctcattgacagcggtagatgtattagacaaaactattccaa
tgtttaacaagggccattttacgagattattaaatccttgtttgataaatgtagccaatgagggttcgagttcaacgacgattgaattctcttcccg
cggatgctgcatgatgaacgacgggatgttgttcgattgatttggaattctttttcgacttttttgtttatattaaatattttaaaatttatagcggatag
caattcatgtaccacggataatgtagacgcgtattgcgcatcgatatctttattattagataaaatttatcaataaatgtgagaagtttgcctcgttaa
ggtcttccatttaaatattatataaacatttgtgtttgtatcttattcgtctttatggaatagttttttactagtaaagctgcaattacacactttgtccgt
aaaacataaatataaacaccagctttatcaatcgttccaaaaagtcgacggcggacattttaacatggcatctattttaaatacacttaggtttt
ggaaaaaacatcattttataattgtaacgattcaataactaaagaaaagattaagattaaacataagggaatgtcatttgtattttataagccaaa
gcattctaccgttgttaaatacttgtctggaggaggtatatatcatgatgatttggttgtattggggaaggtaacaattaatgatctaaagatgatg
ctattttacatggatttatcatatcatggagtgacaagtagtggaacaatttacaaattgggatcgtctatcgatagactttctctaaataggactat
tgttacaaaagttaataattataattatgatacattttttgacgatgatgattgatcgctattgcacaattttgtttttttactttctaatatagcgtttagat
tcttttttcatgtgcgaatattgatttactaaaaatatctatgtttaacttttgttctataacgtccttatcggcggtatcggtacatatacgtaattcacctt
cacaaaatacggagtcttcgataataatagccaatcgattattggatctagctgtctgtatcatattcaacatgtttaatatatcctttcgtttcccctt
tacaggcatcgatcgtagcatattttccgcgtctgagatggaaatgttaaaactacaaaatgcgtaatgttagcccgtcctaatattggtacgt
gtctataagtttggcatagtagaataatagacgtgtttaaatgccttccaaagtttaagaattctattagagtattgcattttgatagtttatcgccta
catcatcaaaaataagtaaaaagtgtgctgattttttatgattttgtgcgacagcaatacattttctatgttactttttagttcgtatcagattatattcta
gagattcctgactactaacgaaattaatatgatttggccaaatgtatccatcataatctggattataaacgggtgtaaacaagaatacatgtttata
tttttttaactagtgtagaaaacagagatagtaaatagatagttttccagatccagatcctcccgttaaaaccattctaaacggcatttttaataaat
tttctcttgaaaattgttttttcttggaaacaattcataattatatttacagttactaaattaatttgataataaatcaaaatatggaaaactaaggtcgtt
agtaggggaggagaacaaagaaggcacatcgtgacataaataacatttattatcatgatgacaccagaaaacgacgaagagcagacatctgt
gttctccgctactgtttacagagacaaaattcagggaaagaataaaacgcaaacgcgtgattggtctatgtattagaatatctatggttatttcact
actatctatgattaccatgtccgcgtttctcatagtgcgcctaaatcaatgcatgtctgctaacgaggctgctattactgacgccgctgttgccgt
tgctgctgcatcatctactcatagaaaggttgcgtctagcactacgcaatatgatcacaaagaaagctgtaatggtttatattaccagggttcttg
ttatatattacattcagactaccagttattctcggatgctaaagcaaattgcactgcggaatcatcaacactacccaataaatccgatgtcttgact
acctggctcattgattatgttaaggatacatggggatctgatggtaatccaattacaaaaactacatccgattatcaagattctgatgtatcacaa
gaagttagaaagtattttgtgttaaaacaatgaactaatatttatttttgtacattaataaatgaaatcgcttaatagacaaactgtaagtaggttta
agaagttgtcggtgccggtcgctataatgatgatactctcaaccattattagtggcataggaacatttctgcattacaaagaagaactgatgcct
agtgcttgcgccaatggatggatacaatacgataaacattgttatttagatactaacattaaaatgtctacagataatgcggtttatcagtgtcgta
aattacgagccagattgcctagaccggatactagacatctgagagtattgtttagtattttttataaagattattgggtaagtttaaaaaagaccaa
tgataaatggttagatattaataatgataaagatatagatattagtaaattaacaaatttaaacaactaaacagtacgacggatgctgaagcgtg
ttatatatacaagtctggaaaactggttaaaacagtatgtaaaagtactcaatctgtactatgtgttaaaaaattctacaagtgacaacaaaaat
gaattaataataagtcgttaacgtacgccgccatggacgccgcgtttgttattactccaatgggtgtgttgactataacagatacattgtatgatg
atctcgatatctcaatcatggactttataggaccatacattataggtaacataaaaactgtccaaatagatgtacgggatataaaatattccgaca
tgcaaaaatgctactttagctataagggtaaaatagttcctcaggattctaatgatttggctagattcaacatttatagcatttgtgccgcatacag
atcaaaaaataccatcatcatagcatgcgactatgatatcatgttagatatagaagataaacatcagccattttatctattcccatctattgatgtttt
taacgctacaatcatagaagcgtataacctgtatacagctggagattatcatctaatcatcaatccttcagataatctgaaaatgaaattgtcgttt
aattcttcattctgcatatcagacggcaatggatggatcataattgatgggaaatgcaatagtaattttttatcataaaagttgtaaagtaaataata
aaacaataaatattgaactagtagtacgtatattgagcaatcagaaatgatgctggtacctcttatcacggtgaccgtagttgcgggaacaatat
tagtatgttatatattatatatttgtaggaaaaagatacgtactgtctataatgacaataaaattatcatgacaaaattaaaaaagataaagagttct

Fig. 58 (cont'd)

aattccagcaaatctagtaaatcaactgatagcgaatcagactgggaggatcactgtagtgctatggaacaaaacaatgacgtagataatattt
ctaggaatgagatattggacgatgatagcttcgctggtagtttaatatgggataacgaatccaatgttatggcgcctagcacagaacacattta
cgatagtgttgctggaagcacgctgctaataaataatgatcgtaatgaacagactatttatcagaacactacagtagtacttaatgaagatacc
aaacagaatcctaactattcatccaatcctttcgtaaattataataaaaccagtatttgtagcaagtcaaatccgttcattacagaactcaacaata
aatttagtgagaataatccgtttagacgagcacatagcgatgattatcttaataagcaagaacaagatcatgaacacgatgatatagaatcatt
ggtgtgattagtttcctttttataaaattgaagtaatatttagtattattgctgccgtcacgttgtacaaatggagatattccctgtattcggcatttcta
aaattagcaattttattgctaataatgactgtagatattatatagatacagaacatcaaaaaattatatctgatgagatcaatagacagatggatga
aacggtacttcttaccaacatcttaagcgtagaagttgtaaatgacaatgagatgtaccatcttattcctcatagattatcgacgattatactctgt
attagttctgtcggaggatgtgttatctctatagataatgacgtcaatggcaaaaatattctaacctttcccattgatcatgctgtaatcatatcccc
actgagtaaatgtgtcgtagttagcaagggtcctacaaccatattggttgttaaagcggatatacctagcaaacgattggtaacatcgtttacaa
acgacatactgtatgtaaacaatctatcactgattaattattcgccgttgtctgtattcattattagacgagttaccgactatttggatagacacatat
gcgatcagatatttgcgaataataagtggtattccattataaccatcgacaataagcagtttcctattccatcaaactgtataggtatgtcctctgc
caagtacataaattctagcatcgagcaagatactttaatacatgtttgtaacctcgagcatccattcgacttagtatacaaaaaaatgcagtcgta
caattctgtacctatcaaggaacaaatattgtacggtagaattgataatataaatatgagcattagtatttctgtggattaatagatttctagtatgg
ggatcattaatcatctctaatctctaaatacctcataaaacgaaaaaaaagctattatcaaatactgtacggaatggattcattctcttctcttttat
gaaactctgttgtatatctactgataaaactggaagcaaaaaatctgataaaaagaataagaataagatcaaggattattataaaataacaatag
ttcctggttcctcttccacgtctactagctcgtggtattatacacatgcctagtaatagtctctttgcgttgacggaaagcagactagaaataaca
ggctaaaatgttcagacaccataatagttcccaacccagataataacagagtaccatcaacacattcctttaaactcaatcccaaacccaaaa
ccgttaaaatgtatccggccaattgatagtagataatgaggtgtacagcgcatgatgatttacacagtaaccaaaatgaaaatactttagtaatt
ataagaaatatagatggtaacgtcatcatcaacaatccaataatatgccggagagtaaacattgacggataaaacaaaaatgctccgcataac
tctatcatggcaataacacaaccaaatacttgtaagattcctaaattagtagaaaatacaacggatatcgatgtataagtgatctcgagaaataa
taagaataaagtaatgcccgtaaagataaacatcaacattgtttggtaatcattaaaccaattagtatgaagttgaactaatttcacagtagatttt
attccagtattatccccgcatgtataagtacctggtaagatatctttatattccataatcaatgagacatcactatctgataacgaatgaagtctag
cactagtatgccatttacttaatattgtcgtcttggaagtttattataagttaaaatatcatggttatccaatttccatctaatatactttgtcggattat
ctatagtacacggaataatgatggtatcattacatgctgtatactctatggtctttgtagttgttataacaaccaacgtatagaggtatatcaacga
tattctaactcttgacatttttatttatttaaaatgatacctttgttatttattttattctattttgctaacggtattgaatggcataagtttgaaacgagtg
aagaaataaatttctacttacttattagacgacgtattatacacggggtgttaatggggcggtatacacatttttcaaataataaactaaacaaaactg
gtttaactaataataattatataacaacatctataaaagtagaggatgcggaaccaataacggaaatcccaaatgttggaaaatagacggttca
gacgacccaaaacatagaggtagaggatacgctccttatcaaaatagcaaagtaacgataatcagtcacaacggatgtgtactatctgacat
aaacatatcaaaagaaggaattaaacgatggagaagatttgacggaccatgtggttatgatttatacacggcggataacgtaattccaaaaga
tggtttacgaggagcattcgtcgataaagatggtacttatgacaaagtttacattcttttcactgatactatcggctcaaagagaattgtcaaaatt
ccgtatatagcacaaatgtgcctaaacgacgaaggtggtccatcatcattgtctagtcatagatggtcgacgtttctcaaagtcgaattagaat
gtgatatcgacggaagaagttatagacaaattattcattctagaactataaaaacagataatgatacgatactatatgtattcttcgatagtcctta
ttccaagtccgcattatgtacctattctatgaataccattaaacaatcttttctacgtcaaaattggaaggatatacaaagcaattgccgtctcca
gctcctggtatatgtttaccagctggaaaagttgttccacataccacgtttgaagtcatagaaaaatataatgtactagatgatattataaagcctt
tatctaaccaacctatcttcgaaggaccgtctggtgttaaatggttcgatataaaggagaaggaaatgaacatcgggaatatagaatatactt
cataaaagaaaattctatatattcgttcgatacaaaatctaaacaaactcgtagctcgcaagtcgatgcgcgactattttcagtaatggtaacttc
gaaaccgttatttatagcagatatagggataggagtaggaatgccacaaatgaaaaaaatacttaaaatgtaatcttaatcgagtacaccgca
cgacaatgaacaaacataagacagattatgctggttatgcttgctgcgtaatatgcggtctaattgttggaattattttacagcgacactattaaa
agttgtagaacgtaaattagttcatacaccatcaatagataaaacgataaaagatgcatatattagagaagattgtcctactgactggataagct
ataataataaatgtatccatttatctactgatcgaaaaacctgggaggaaggacgtaatgcatgcaaagctctaaatccaaattcggatctaatt
aagatagagactccaaacgagttaagttttttaagaagcattagacgcggatattgggtaggagaatccgaaatattaaaccagacaacccc
atataatttatagctaaaaatgccacgaagaatggaactaaaaaacggaaatatatttgtagtacaacgaatactcccaaactacatttttatca
taccactacttcggttagatgttttagaaaaaaataaatatcgccgtaccgttcttgtttttataaaaataacaattaacaattatcaaatttttttcttta
atattttacgtggttgaccattcttggtggtaaaataatctcttagtgttggaatggaatgctgtttaatgtttccgcactcatcgtatattttgacgta

Fig. 58 (cont'd)

tgcagtcacatcgtttacgcaatagtcagactgtagttctatcatgcttcctacatcagaaggaggaacagttttaaagtctcttggttttaatctat
tgccattagttttcatgaaatcctttgttttatccacttcacattttaaataaatgtccactatacattcttctgttaattttactagatcgtcatgggtcat
agaatttataggttccgtagtccatggatccaaactagcaaacttcgcgtatacggtatcgcgattagtgtatacaccaactgtatgaaaattaa
gaaaacagtttaataaatcaacagaaatatttaatcctccgtttgatacagatgcgccatatttatggatttcggattcacacgttgtttgtctgag
gtgttcgtctagtgttgcttctacgtaaacttcgattcccatatattctttattgtcagaatcgcataccgatttatcatcatacactgtttgaaaacta
aatggtatacacatcaaaataataaataataacgagtacattctgcaatattgttatcgtaattggaaaaatagtgttcgagtgagttggattatgt
gagtattggattgtatatttatttatattttatattttgtagtaagaatagaatgctaatgtcaagtttattccaatagatgtcttattaaaaaacatata
taataaataacaatggctgaatggcataaaattatcgaggatatctcaaaaaataataagttcgaggatgccgccatcgttgattacaagacta
caaagaatgttctagctgctattcctaacagaacatttgccaagattaatcctctcatcactaatcgtaatattctaaaacctcttattggtcagaaa
tattgtattgtatatactaactctctaatggatgagaacacgtatgctatggagttgcttactgggtacgcccctgtatctccgatcgttatagcga
gaactcataccgcacttatattttgatgggtaagccaacaacatccagacgtgacgtgtatagaacgtgtagagatcacgctacccgtgtac
gtgcaactggtaattaaaataaaaagtaatattcatatgtagtgtcaattttaaatgatgatgatgaaatggataatatccatattgacgatgtcaat
aatgccggtattggcatacagttcatcgatttttagatttcattcagaggatgtggaattatgttatgggcatttgtattttgataggatctataatgt
agtaaatataaaatataatccgcatattccatatagatataattttattaatcgcacgttaaccgtagatgaactagacgataatgtcttttttacaca
tggttatttttttaaaacacaaatatggttcacttaatcctagtttgattgtctcattatcaggaaacttaaaatataatgatatacaatgctcagtaaat
gtatcgtgtctcattaaaaatttggcaacgagtacatctactatattaacatctaaacataagacttattctctacatcggtccacgtgtattactata
ataggatacgattctattatatggtataaagatataaatgacatctatgattttactgcaatatgtatgctaatagcgtctacattgatagtgaccat
atacgtgtttaaaaaaataaaaatgaactcttaattatgctatgctattagaaatggataaaatcaaaattacggttgattcaaaaattggtaatgtt
gttaccatatcgtataacttggaaaagataactattgatgtcacacctaaaagaaaaaagaaaaggatgtattattagcgcaatcagttgctgt
cgaagaggcaaaagatgtcaaggtagaagaaaaaaatattatcgatattgaagatgacgatgatatggatgtagaaagcgcataatacgatc
tataaaaataagtatataaatactttttatttactgtactcttactgtgtagtggtgataccctactcgattattttttaaaaaaaaaatacttattctgatt
cttctagccatttccgtgttcgttcgaatgccacatcgacgttaaagataggggagtagttgaaatctagttctgcattgttggtacgcacctcaa
atgtagtgttggatatcttcaacgtatagttgttgagtagtgatggttttctaaatagaattctcttcatatcattcttgcacgcgtacattttagcatc
catcttggaatcctagatccttgttctattcccaatggtttcatcaatagaagattaaacatatcgtacgaacacgatggagagtaatcgtagcaa
aagtaagcatttcctttaatctcagatcccggatactggatatattttgcagccaacacgtgcatccatgcagcatttcctacatatacccggcta
tgtaccgcgttatcatcgactgtacgatacataatgttaccgtgttgcttacattgctcgtaaaagactttcatcaatttgtctccttctccgtaaatt
ccagtgggtcttaggcaacaagtatacaattttgctccattcatgattacggaattattggctttcataaccagttgctcggccatacgtttactttt
gcgtatacatgtcctggtgatatatcataaagggtatgctcatggccgatgaatggatcaccgtgtttattgggtcctattgcttccatgctacta
gtatagatcaaatacttgattcctaggtccacacaagctgccaatatagtctgtgttccataatagtttactttcatgatttcattatcggtgtattttc
caaatacatccactagagcagctgtatgaataatcagatttaccccatctagcgcttctcttaccttatcaaagtcgtttatatcacattgtatatag
tttataaccttaactttcgaggttattggttgtggatcttctacaatatctatgactctgatttcttgaacatcatctgcactaattaacagttttactata
tacctgcctagaaatccggcaccaccagtaaccgcgtacacggccattgctgccactcataatatcagactacttattctattttactaaataat
ggctgtttgtataatagaccacgataatatcagaggagttatttactttgaaccagtccatggaaaagataaagttattggattaaaatccggaa
cgtatagtttgataattcatcgttacggagatattagtcaaggatgtgattccataggcagtccagaaatatttatcggtaacatctttgtaaacag
atatggtgtagcatatgtttatttagatacagatgtaaatatatctacaattattggaaaggcgttatctatttcaaaaaatgatcagagattagcgt
gtggagttattggtatttcttacataaatgaaaagataatacattttcttacaattaacgagaatggcgtttgatatatcagttaatgcgtctaaaac
aataaatgcattagtttttacttttctactcagcaaaataaattagtcatacgtaatgaagttaatgatacacactcactgtcgaatttgataggggac
aaagtagttgacacgtttatttcatataatagacataatgactccatagagataagaggggtgcttccagaggaaactaatattggttgcgcggt
taatacgccggttagtatgacttacttgtataataagtatagttttaaactgattttagcagaatatataagacacagaaatactatatccggcaat
atttattcggcattgatgacactagatgatttggctattaaacagtatggagacattgatctattatttaatgagaaacttaaagtagactccgattc
gggactatttgactttgtcaacttgtaaaggatatgatatgttgtgattctagaatagtagtagctctatctagtctagtatctaaacattgggaatt
gacaaataaaaaatataggtgtatggcattagccgaacatatatctgatagtattccaatatctgagctatctagactacgatacaatctatgtaa
gtatctacgcgggcacactgagagcatagaggatgaatttgattattttgaagacgatgattcgtctacatgttctgccgtaaccgacagggaa
acggatgtataattttttttatagcgtgaaggatatgataaaaaatataattgttgtatttatcccattccaatcaccttatatgattctgtaacacaat
gaaggagtcttatagatgtatagaggtcagatactggtttgataaactgtttattccacataagtatgtttgactttatggttagacccgcatacttt

Fig. 58 (cont'd)

aacaaatcactgaaaattggagttaggtattgacctctcagaatcagttgccgttctggaacattaaatgtatttttatgatatactccaacgcatt
tatgtgggcatacaacaagtcattactaatggagtattccaagagaagagatttcaacagactgtttatgaactcgaatgccgcctcattgtcgc
ttatattgatgatgtcgaattctcccaatatcatcaccgatgagtagctcatcttgttatcgggatccaagttttctaaagatgtcattaaaccctcg
atcatgaatggatttatcatcatcgtttttatgttggacatgagcttagtccgtttgtccacatctatagacgacgatttctgaattatttcatatatcc
ctctctttaactccaggaacttgtcaggatggtctactttaatatgttctcgtctaagagatgaaaatctttggatggttgcacgcgactttctcta
aaggatcctctcttaaatgaatccatcttatccttggacaagatggacagtctattttccttagatggtttaatattttttgttacccatgatctataaag
gtagacctaatcgtctcggatgaccatatatttattttcagttttattatacgcataaattgtaaaaaatatgttaggtttacaaaaatgtctcgtggg
gcattaatcgttttgaaggattggacaaatctggaaaaacaacacaatgtatgaacatcatggaatctataccggcaaacacgataaaatatc
ttaactttcctcagagatccactgtcactggaaagatgatagatgactatctaactcgtaaaaaaacctataatgatcatatagttaatctattatttt
gtgcaaatagatgggagtttgcatctttatacaagaacaactagaacagggaattactttaatagttgatagatacgcattctctggagtagcg
tatgccgccgctaaaggcgcgtcaatgactctcagtaagagttatgaatctggattgcctaaacccgacttagttatattcttggaatctggtag
caaagaaattaatagaaacgtcggcgaggaaatttatgaagatgttacattccaacaaaaggtattacaagaatataaaaaaatgattgaaga
aggagatattcattggcaaattatttcttctgaattcgaggaagatgtaaagaaggagttgattaagaatatagttatagaggctatacacacgg
ttactggaccagtggggcaactgtggatgtaatagtgaaattacatttttatataatggatgaagcatattactctggcaacttggaatcagtact
cggatacgtgtccgatatgcataccgaactcgcatcaatatctcaattagttattgccaagatagaaactatagataatgatatattaaacaagg
acattgtaaattttatcatgtgtagatcaaacttggataatccatttatctctttcctagatactgtatatactattatagatcaagagatctatcagac
cgaattgattaattcattagacgacaatgaaattatcgattgtatagttaacaagtttatgagctctttataaggataacctagaaaatatagtagatg
ctatcattactctaaaatatataatgaataatccagattttaaaactacgtatgccgaagtactcggttccagaatagcggatatagatattaaaca
agtgatacgtgagaatatactacaattgtctaataatatccgcgaacgatatttgtgaaaatattaaaaaaaaatacttttttttattaaatgacgtcg
cttcgcgaatttagaaaattatgctgtgatatatatcacgcatcaggatataaagaaaaatctaaattaattagagactttataacagatagggat
gataaatatttgatcattaagctattgcttcccggattagacgatagaatttataacatgaacgataaacaaattataaaattatatagtataatattt
aaacaatctcaggaagatatgctacaagatttaggatacggatatataggagacactattaggactttcttcaaagagaacacagaaatccgt
ccacgagataaaagcattttaactttagaagaagtggatagtttttaactacgttatcatccgtaactaaagaatcgcatcaaataaaattattga
ctgatatcgcatccgtttgtacatgtaatgatttaaaatgtgtagtcatgcttattgataaagatctaaaaattaaagcgggccctcggtacgtact
taacgctattagtcctcatgcctatgatgtgtttagaaaatctaataacttgaaagagataatagaaaatgcatctaaacaaaatctagactctata
tctatttctgttatgactccaattaatcccatgttagcggaatcgtgtgattctgtcaataaggcgtttaaaaaaatttccatcaggaatgtttgcgga
agtcaaatacgatggtgaaagagtacaagttcataaaaaataataacgagtttgccttctttagtagaaacatgaaaccagtactctctcataaag
tggattatctcaaagaatacataccgaaagcatttaaaaaagctacgtctatcgtattggattctgaaattgttcttgtagacgaacataatgtacc
gctcccgtttggaagtttaggtatacacaaaaagaaagaatataaaaactctaacatgtgtttgttcgtgtttgactgtttgtactttgatggattcg
atatgacggacattccattgtacgaacgaagatctttctcaaagatgttatggttgaaatacccaatagaatagtattctcagagttgacgaata
ttagtaacgagtctcagttaactgacgtattggatgatgcactaacgagaaaattagaaggattggtcttaaaagatattaatggagtatacgaa
ccgggaaagagaagatggttaaaaataaagcgagactatttgaacgagggttccatggcagattctgccgatttagtagtactaggtgcttac
tatggtaaaggagcaaagggtggtatcatggcagtctttctaatgggttgttacgacgatgaatccggtaaatggaagacggttaccaagtgt
tcaggacacgatgataatacgttaagggagttgcaagaccaattaaagatgattaaaattaacaaggatcccaaaaaaattccagagtggtta
gtagttaataaaatctatattcccgatttgtagtagaggatccaaaacaatctcagatatgggaaatttcaggagcagagtttacatcttccaag
tcccataccgcaaatggaatatccattagatttcctagatttactaggataagagaggataaaacgtggaaagaatctactcatctaaacgattt
agtaaacttgactaaatcttaatagttacatacaaattaaaataacactatttagttggtggtcgccatggatggtgttattgtatactgtctaaacg
cgttagtaaaacatggcgaggaaataaatcatataaaaaatgatttcatgattaaaccatgttgtgaaaaagtcaagaacgttcacattggcgg
acaatctaaaaacaatacagtgattgcagatttgccatatatggataatgcggtatccgatgtatgcaattcactgtataaaaagaatgtatcaa
gaatatccagatttgctaatttgataaagatagatgacgatgacaagactcctactggtgtatataattatttttaaacctaaagatgccattcctgtt
attatatccataggaaaggatagagatgtttgtgaactattaatctcatctgataaagcgtgtgcgtgtatagagttaaattcatataaagtagcc
attcttcccatggatgtttcctttttttaccaaaggaaatgcatcattgattattctcctgtttgatttctctatcgatgcggcacctctcttaagaagtgt
aaccgataataatgttattatatctagacaccagccgtctacatgacgagcttccgagttccaattggttcaagtttacataagtataaagtccga
ctattgttctatattatatatggttgttgatggatctgtgatgcatgcaatagctgataatagaacttacgcaaatattagcaaaaatatattagaca
atactacaattaacgatgagtgtagatgctgttattttgaaccacagattaggattcttgatagagatgagatgctcaatggatcatcgtgtgatat

Fig. 58 (cont'd)

gaacagacattgtattatgatgaatttacctgatgtaggcgaatttggatctagtatgttggggaaatatgaacctgacatgattaagattgctctt
tcggtggctggtaaaaaattgaaaataaatacaaaggttcttgagggttgtgttaaattgaaagcgagaaataatcataaataagataaacgcc
gccaccatgtttgtctttcttgtcttattgccactagtctctagtcagtgtgttaatcttacaaccagaactcaattaccacctgcatacactaattctt
tcacacgtggtgtttattaccctgacaaagtattcagatcctcagtattacattcaactcaggacttgttcttacctttcttctccaatgttacttggtt
ccatgctatacatgtctctgggaccaatggtactaagaggtttgataaccctgtcctaccatttaatgatggtgtttatttcgcttccactgagaag
tctaacataataagaggctggatatttggtactactttagattcgaagacccagtccctacttattgttaataacgctactaatgttgttattaaagt
ctgtgaatttcaattctgtaatgatccattcttgggtgtttattaccacaagaacaacaagagttggatggaaagtgagttcagagtttattctagt
gcgaataattgcactttcgaatatgtctctcagcctttccttatggaccttgaaggtaaacagggtaatttcaagaatcttagggaatttgtgtttaa
gaatattgatggttatttcaagatatattctaagcacacgcctattaatttagtgcgtgatctccctcagggtttctcggctttagaaccattggtag
atttgccaataggtattaacatcactaggtttcaaactttacttgctttacatagaagttatttgactcctggtgattcttcttcaggttggacagctg
gtgctgcagcttattatgtgggttatcttcaacctaggactttcctattgaaatataatgagaatggaaccattacagatgctgtagactgtgcact
tgaccctctctcagaaacaaagtgtacgttgaaatccttcactgtagagaaaggaatctatcaaacttctaactttagagtccaaccaacagaat
ctattgttagatttcctaatattacaaacttgtgcccctttcggtgaagtatttaacgccaccagatttgcatctgtttatgcttggaacaggaagaga
atcagcaactgtgttgctgattattctgtcctatataattccgcatcattctccacatttaagtgttatggagtgtctcctactaaattaaatgatctct
gctttactaatgtctatgcagattcatttgtaattagaggtgatgaagtcagacaaatcgctccagggcaaactggaaagattgctgattataatt
ataaattaccagatgactttacaggctgcgttatagcttggaattctaacaatcttgattctaaggttggtggtaattataattacctgtatagattgt
ttaggaagtctaatctcaaacctttcgagagagatatttcaactgaaatctatcaggccggtagcacaccttgaatggtgttgaaggatttaatt
gttactttcctttacaatcatatggtttccaacccactaatggtgttggttaccaaccatacagagtagtagtactttcatttgaacttctacatgcac
cagcaactgtttgtggacctaagaagtctactaatttggttaagaacaaatgtgtcaatttcaacttcaatggtttaacaggcacaggtgttcttac
tgagtctaacaagaagtttctgcctttccaacaatttggcagagacattgctgacactactgatgctgtccgtgatccacagacacttgagattc
ttgacattacaccatgttcatttggtggtgtcagtgttataacaccaggaacaaatacttctaaccaggttgctgttctttatcaggatgttaactgc
acagaagtccctgttgctattcatgcagatcaacttactcctacttggccgtgtttattctacaggttctaatgtatttcaaacacgtgcaggctgttt
aataggagctgaacatgtcaacaactcatatgagtgtgacatacccattggtgcaggtatatgcgctagttatcagactcagactaattctcctc
ggcgggcacgtagtgtagctagtcaatccatcattgcctacactatgtcacttggtgcagagaattcagttgcttactctaataactctattgcca
tacccacaaactttactattagtgttaccacagaaattctaccagtgtctatgaccaagacatcagtagattgtacaatgtacatttgtggtgattc
aactgaatgcagcaatctattgttgcaatatggcagtttctgtacacaattaaaccgtgctttaactggaatagctgttgaacaagacaagaaca
cccaagaagtatttgcacaagtcaaacaaatttacaagacaccaccaattaaagatttcggtggatttaatttctcacaaatattaccagatccat
ctaaaccaagcaagaggtcatttattgaagatctactattcaacaaagtgacacttgcagatgctggcttcatcaaacaatatggtgattgcctt
ggtgatattgctgctagagacctcatttgtgcacagaagtttaacggccttactgtattgccaccctttgctcacagatgaaatgattgctcaatac
acttctgcactgttagcgggtacaatcacttctggttggacctttggtgcaggtgctgcattacaaataccatttgctatgcaaatggcttatagg
tttaatggtattggagttacacagaatgttctctatgagaaccagaaattgattgccaaccaatttaatagtgctattggcaagattcaagactca
ctttcttccacagcaagtgcacttggtaaacttcaagatgtggtcaaccagaatgcacaagctttaaacacgcttgttaaacaacttagctccaa
ctttggtgcaatttcaagtgtattaaatgatatcctttcacgtcttgacaaagttgaggctgaagtgcaaattgataggttgatcacaggcagactt
caaagtttgcagacatatgtgactcaacaattaattagagctgcagaaatcagagcttctgctaatcttgctgctactaagatgtcagagtgtgt
acttggacaatctaagagagttgatttctgtggaaagggctatcatcttatgtccttccctcagtcagcacctcatggtgtagtcttcttgcatgtg
acttatgtccctgcacaagagaagaacttcacaactgctcctgccatttgtcatgatggtaaagcacactttcctcgtgaaggtgtctttgtttca
aatggcacacactggtttgtaacacaaaggaattctatgaaccacaaatcattactacagacaacacatttgtgtctggtaactgtgatgttgta
ataggaattgtcaacaacacagtttatgatcctttgcaacctgaattagactcattcaaggaggagttagataaatatttcaagaatcatacatca
ccagatgttgatttaggtgacatctctggcattaatgcttcagttgtaaacattcagaaagaaattgaccgcctcaatgaggttgccaagaattta
aatgaatctctcatcgatctccaagaacttggaaagtatgagcagtatatcaaatggccatggtacatttggctaggtttcatagctggcttgatt
gccatagtaatggtgacaattatgctttgctgtatgaccagttgctgtagttgtctcaagggctgttgttcttgtggatcctgctgcaaatttgatga
agacgactctgagccagtgctcaaaggagtcaaattacattacacataaggcgcgcctttttatactagtatttggaaagttttataggtagttga
tagaacaaaatacataattttgtaaaaataaatcacttttttatactaatatgacacgattaccaatacttttgttactaatatcattagtatacgctaca
cctttcctcagacatctaaaaaaataggtgatgatgcaactttatcatgtaatcgaaataatacaaatgactacgttgttatgagtgcttggtata
aggagcccaattccattattctttagctgctaaaagcgacgtcttgtattttgataattataccaaggataaaatatcttacgactctccatacgat

Fig. 58 (cont'd)

gatctagttacaactatcacaattaaatcattgactgctagagatgccggtacttatgtatgtgcattctttatgacatcgcctacaaatgacactg
ataaagtagattatgaagaatactccacagagttgattgtaaatacagatagtgaatcgactatagacataatactatctggatctacacattcac
cggaaactagttctgagaaacctgattatatagataattctaattgctcgtcggtattcgaaatcgcgactccggaaccaattactgataatgta
gaagatcatacagacaccgtcacatacactagtgatagcattaatacagtaagtgcatcatctggagaatccacaacagacgagactccgg
aaccaattactgataaagaagaagatcatacagttacagacactgtctcatacactacagtaagtacatcatctggaattgtcactactaaatca
accaccgatgatgcggatctttatgatacgtacaatgataatgatacagtaccatcaactactgtaggcggtagtacaacctctattagcaatta
taaaaccaaggactttgtagaaatatttggtattaccgcattaattatattgtcggccgtggcaatattctgtattacatattatatatataataaaacg
ttcacgtaaatacaaaacagagaacaaagtctagattttttgacttacataaatgtctgggatagtaaaatctatcatattgagcgggccatctggt
ttaggaaagacagccatagccaaaagactatgggaatatatttggatttgtggtgtcccataccactagatttcctcgtcctatggaacgagaa
ggtgtcgattaccattacgttaacagagaggccatctggaagggaatagccgccggaacatactgagtttttaggaaatatttacggaacttct
aaaactgctgtgaatacagccggctattaataatcgtatttgtgtgatggatctaaacatcgacggtgttagaagtttaaaaatacttacctaatgc
cttactcggtgtatataagacctacctctcttaaaatggttgagaccaagcttcgttgtagaaacactgaagcggatgatgagattcatcgtcgt
gtgatgttggcaaaaactgacatggatgaggcaggtgaagccggtctattcgacactattatcattgaagatgatgtgaatttagcatatagta
agttaattcagatactacaggaccgtattagaatgtattttaacactaattagagacttaagacttaaaacttgataattaataatataactcgttttt
atatgtggctatttcaacgtctaatgtattagttaaatattaaaacttaccacgtaaaacttaaaatttaaaatgatatttcattgacagatagatcac
acattatgaactttcaaggacttgtgttaactgacaattgcaaaaatcaatgggtcgttggaccattaataggaaaaggtggatttggtagtattt
atactactaatgacaataattatgtagtaaaaatagagcccaaagctaacggatcattatttaccgaacaggcattttatactagagtacttaaac
catccgttatcgaagaatggaaaaaatctcacaatataaagcacgtaggtcttatcacgtgcaaggcatttggtctatacaaatccattaatgtg
gaatatcgattcttggtaattaatagattaggtgcagatctagatgcggtgatcagagccaataataatagattaccaaaaaggtcggtgatgtt
gatcggaatcgaaatcttaaataccatacaatttatgcacgagcaaggatattctcacggagatattaaagcgagtaatatagtcttggatcaa
atagataagaataaattatatctagtggattacggattggtttctaaattcatgtctaatggcgaacatgttccatttataagaaatccaaataaaat
ggataacggtactctagaatttacacctatagattcgcataaaggatacgttgtatctagacgtggagatctagaaacacttggatattgtatgat
tagatggttgggaggtatcttgccatggactaagatatctgaaacaaagaattgtgcattagtaagtgccacaaaacagaaatatgttaacaat
actgcgactttgttaatgaccagtttgcaatatgcacctagagaattgctgcaatatattaccatggtaaactctttgacatattttgaggaaccca
attacgacaagtttcggcacatattaatgcaggggtgtatattattaagtgtggtgtttggttgatgtaaaattttttgtcgataaaaattaaaaaataa
cttaatttattattgatctcgtgtgtacaaccgaaatcatggcgatgtttacgcacacgctctcggtgggtacgacgagaatcttcatgcctttcc
tggaatatcatcgactgttgccaatgatgtcagtttataataacaagtatgacattgtaaaagacaaatatatggtgttacagtcaggtgaaca
agagatatattggagcactgctgcctatgtttgagtgcaatgaatatctacaaattggagatccgatccatgatcaagaaggaaatcacatatc
gccacaaaaactactatgctctaagcggaatcgggtacgagagtctagacttgtgtttggaaggagtagggattcatcatcacgtacttgaaa
cagaaaacgctgtatatggaaaagttcaacatgattattctactatcaaagagaaggccaaagaaatgaatgcactcagttcaggacctatca
tcgattaccacgtctggataggagattgtatctgtcaagttactgctgtggacgtacatggaaaggaaattatgagaatgagattcaaaaagg
gtgcggtgcttccgatcccaaatctggtaaaagttaaacttggggagaatgatacagaaaatctttcttctactatatcggcggcaccatcgag
gtaaccacctctctggaagacagtgtgaatcatgtactcatgaaacgtttggaatctatacgccatatgtggtctgttgtatatgatcattttgatat
tgtgaatggtaaagaatgctgttatgtgcatacgcatttgtctaatcaaaatcttataccgagtactgtaaaaacaaatttgtacatgaagactatg
ggatcatgcattcaaatgagtatcttagcgaactgaaggaatcaggtggatggagtcccagaccagaaatgcaggaatttgaatatccagat
ggagtggaagacactgaatcaattgagagagattggtagaggagttcttcaatagatcagaacttcaggctggtaaatcattaatgttaaacata
catctgtttcagctaagcaactaagaacacgtatactctcatctttttgccaacacagagggtggatatttgttcattggagttgataataatacac
acaaagtatttggattcacggtgggttacgactacctcagactgatagagaatgatatagaaaagcatatcaaaagactttgtgttgtgtatttct
gtgagaagaaagaggacatcaagtacacgtgtcgattcatcaaggtatataaacctggggatgaggctacctcgacatacgtgtgcgctatc
aaagtggaaagatgctgttgtgctgtgtttgcagattggccagaatcatggtatcaagaagtattctccagatgaataggtgtcacatataaaat
tttaattaatgtaactatagagaacaaataataggttgtaatatcatatagacaataactaacaattaattagtaactgttatctcttttttaactaacta
actatacctattaatacatcgtaattatagttcttaacatctattaatcattgattcgcttctttaatttttttataaaccaacattgttaattgaaaaggga
taacatgttacagaatataaaattatatgtggatttttttttaaaaaggaaatacttgactggagtgtatatttatctcttcattatatagcacgcgtgtttt
ccaattttttccacatcccatataatacaggattataatctcgttcgaacatacgagaaagtggataaaacaatagttgattttttatctaggttgcca
aatttattccatatttttagaatatggggaaaatattctacatatttattctatggatgatgctaatacgaatattataatttttttttctagatagagtattaa

Fig. 58 (cont'd)

atattaataagaacgggtcatttatacacaatctcaggttatcatcatccattaatataaaagaatatgtatatcaattagttaataatgatcatcca
gataataggataagactaatgcttgaaaatggacgtagaacaagacatttttgtcctatatatcagatacagttaatatctatatatgtattttatat
agatgccgaagacagttacggttgtacattattacatagatgtatatatcactataagaaatcagaatcagaatcagaatcatacaatgaattaat
taagatattgttaaataatggatcagatgtagataaaaaagatacgtacggaaacacacctttttatcctattatgtaaacacgatatcaacaacgt
ggaattgtttgagatatgtttagagaatgctaatatagactctgtagactttaatagatatacacctcttcattatgtctcatgtcgtaataaatatga
ttttgtaaagttattaatttctaaaggagcaaatgttaatgcgcgtaataaattcggaactactccattttattgtggaattatacacggtatctcgct
tataaaactatatttggaatcagacacagagttagaaatagataatgaacatatagttcgtcatttaataattttgatgctgttgaatctttagattat
ctattatccagaggagttattgatattaactatcgtactatttacgacgctgtcagttataatgcgtataatacgttggtctatctattaaacagaaat
ggtgattttgagacgattactactagtggatgtacatgtatttcggaagcagtcgcaaacaacaacaaataataatggaagtactattgtctaa
acgaccatctttgaaaattatgatacagtctatgatagcaattactaaacataaacagcataatgcagatttattgaaaatgtgtataaaatatact
gcgtgtatgaccgattatgatactcttatagatgtacaatcactacagcaatataaatggtatattttaagatgtttcgatgaaatagatatcatgaa
gagatgttatataaaaaataaaactgtattccaattagtttttgtatcaaagacattaatactttaatgagatacggtaaacatccttcttcgtgaa
gtgcactagtctcgacgtatacggaagtcgtgtacgtaatatcatagcatctattagatatcgtcagagattaattagtctattatccaagaagct
ggatcctggagatataatggtcgtgtttttcctaacgaaataaaatataacgataacgaactgtccacatatctaaaaatcttataaacactattaaa
atataaaatcacactacatcattgtttcctttttagtgctcgacagtgtatactatttttaacgctcataaataaaaatgaaaacgatttccgttgttac
gttgttatgcgtactacctgctgttgtttattcaacatgtactgtacccactatgaataacgctaaattaacgtctaccgaaacatcgtttaataata
accagaaagttacgtttacatgtgatcagggatatcattcttcggatccaaatgctgtctgcgaaacagataaatggaaatacgaaaatccatg
caaaaaaatgtgcacagtttctgattacatctctgaactatataataaaaccgctatacgaagtgaattccaccatgacactaagttgcaacggc
gaaacaaaatattttcgttgcgaagaaaaaaatggaaatacttcttggaatgatactgttacgtgtcctaatgcggaatgtcaacctcttcaatta
gaacacggatcgtgtcaaccagttaaagaaaaatactcatttggggaatatataactatcaactgtgatgttggatatgaggttattggtgcttc
gtacataagttgtacagctaattcttggaatgttattccatcatgtcaacaaaaatgtgatataccgtctctatctaatggattaatttccggatctac
attttctatcggtggcgttatacatcttagttgtaaaagtggtttttatactaacgggatctccatcatccacatgtatcgacggtaaatggaatccc
atactcccaacatgtgtacgatctaacgaaaaatttgatccagtggatgatggtcccgacgatgagacagatttgagcaaactctcgaaagac
gttgtacaatatgaacaagaaatagaatcgttagaagcaacttatcatataatcatagtggcgttaacaattatgggcgtcatattttaatctccg
ttatagtattagtttgttcctgtgacaaaaataatgaccaatataagttccataaattgctaccgtgaatataaatccgttaaaataatgaataattaa
taattaataatttaataacaaacaagtatcaaaagattaaagacttatagctagaatcaattgagatgtcttcttcagtggatgttgatatctacgat
gccgttagagcattttactcaggcactattataacaagagatttattgtgtatggaagaagtaacgccatattacataatatatacaggctattta
caagatgcgccgttataccgttcgatgatatagtacgtactatgccaaatgaatcacgtgttaaacaatgggtgatggatacacttaatggtata
atgatgaatgaacgcgatgtttctgtaagcgttggcaccggaatactattcatggaaatgttttttcgattacaataaaaatagtatcaacaatcaa
ctaatgtatgatataattaatagcgtatctataattctagctaatgagagatatagaagcgctttttaacgacgatggtatatacatccgtagaaata
tgattaacaagttgtacggatacgcatctctaactactattggcacgatcgctggaggtgtttgttattatctgttgatgcatctcagttagtttgtata
aataattatttcaatatactagttaaaattttaagattttaaatgtataaaaaactaataacgtttttatttgtaataggtgcattagcatcctattcgaat
aatgagtacactccgtttaataaactgagtgtaaaactctatatagatggagtagataatatagaaaattcatatactgatgataataatgaattg
gtgttaaattttaaagagtacacaatttctattattacagagtcatgcgacgtcggatttgattccatagatatagatgttataaacgactataaaat
tattgatatgtctactattcaacgcagaggtcacacgtgtagaatatctaccaaattatcatgccattatgataagtacccttatattcacaaatatg
atggtgatgagcgacaatattctattactgcagagggaaaatgctataaaggaataaaatatgaaataagtatgatcaacgatgatactctattg
agaaacatactcttaaaattggatctacttatatatttgatcgtcatggacatagtaatacatattattcaaaatatgattttaaaaatttaaaatat
attatcacttcagtgacagtagtcaaataacaaacaacaccatgagatatattataattctcgcagttttgttcattaatagtatacacgctaaaata
actagttataagtttgaatccgtcaattttgattccaaaattgaatggactggggatggtctatacaatatatcccttaaaaattatggcatcaaga
cgtggcaaacaatgtatacaaatgtaccagaaggaacatacgacatatccgcatttccaaagaatgatttcgtatctttctgggttaaatttgaa
caaggcgattataaagtggaagagtattgtacgggaccaccgactgtaacattaactgaatacgacgaccatccgtatgctactagaggtag
caaaaagattcctatttacaaacgcggtgacatgtgtgatatctacttgttgtatacggctaacttcacattcggagattctaaagaaccagtacc
atatgatatcgatgactacgattgcacgtctacaggttgcagcatagactttgtcacaacagaaaaagtgtgcgtgacagcacagggagcca
cagaagggtttctcgaaaaaattactccatggagttcgaaagtatgtctgacacctaaaaagagtgtatatacatgcgcaattagatccaaaga
agatgttcccaatttcaaggacaaaatggccagagttatcaagagaaaatttaactaaatttctcggtagcacatcaaatgatgttaccactttc

Fig. 58 (cont'd)

```
ttagcatgcttaacttgactaaatattcataactaattttattaatgatacaaaaacgaaataaaactgcatattatacactggttaacgcccttata
ggctctaaccattttcaagatgaggtccctgattatagtccttctgttcccctctatcatctactccatgtctattagacgatgtgagaagactgaa
gaggaaacatggggattgaaaatagggttgtgtataattgccaaagatttctatcccgaaagaactgattgcagtgttcatctcccaactgcaa
gtgaaggcaatggattcagggatatacgaaacaccgataaattataaaaaaagcaatgtgtccgctgtttccgttaataatactattttcgtaact
ggcggattattcataaataactctaatagcacgatcgtggttaacaatatggaaaaacttgacatttataaagacaaacaatggtcgattataga
aatgcctatggctagggtatatcacggcatcgactcgacatttggaatgttatattttgccggaggtctatccgttaccgaacaatatggtaattt
agagaaaaacaacgagatatcttgttacaatcctagaacgaataagtggtttgatatttcatatactatttataagatatccatatcatcattgtgta
aactaaataacgtcttctatgtatttagtaaggacattggatatgtggaaaagtatgatggtctccccgctataaaggcattatcaacttctccttat
tgattgaaaatgaaaatataaatagtttttatgtatagcagtattaccctatagtttattgcttactactaacatggatacagatacagatgttacaa
atgtagaagatatcatgaatgaaatagatagagagaaagaagaaatactaaaaaatgtagaaattgaaaataataaaaacattaacaagaatc
atcccaatgaatatattagagaagcactcgttattaatacaagtagtaatagtgattccattgataaagaagttatagaatgtatcagtcacgatg
taggaatatagatcatatctactaattttataatcaatacaaaacataaaaaacaactcgttattacatagcaggcatggaatccttcaagtattgt
tttgataacgatggcaagaaatggattatcggaaatactttatattctggtaattcaatactctataaggtcagaaaaaatttcactagttcgttcta
caattacgtaatgaagatagatcacaaatcacacaagccattgttgtctgaaatacgattctatatatctgtattggatcctttgactatcgacaac
tggacacgggaacgtggtataaagtatttggctattccagatctgtatggaattggagaaaccgatgattatatgttcttcgttataaagaatttg
ggaagagtattcgccccaaaggatactgaatcagtcttcgaagcatgcgtcactatgataaacacgttagagtttatacactctcgaggattta
cccatggaaaaatagaaccgaggaatatactgattagaaataaacgtctttcactaattgactattctagaactaacaaactatacaagagtgg
aaactcacatatagattacaacgaggacatgataacttcaggaaatatcaattatatgtgtgtagacaatcatcttggagcaacagtttcaaaac
gaggagatttagaaatgttgggatattgcatgatagaatggttcggtggcaaacttccatggaaaaacgaaagtagtataaaagtaataaaac
aaaaaaaagaatataaaaaatttatagctactttctttgaggactgttttcctgaaggaaatgaacctctggaattagttagatatatagaattagt
atacacgttagattattctcaaactcctaattatgacagactacgtagactgtttatacaagattgaaatattcttttttatagagtgtggtagtgtta
cggatatctaatattaatattagactatctctatcgcgctacacgaccaatatcgattactatggatatcttctatgaaaggagagaatgtattcatt
tctccagcgtcaatctcgtcagtattgacaatactgtattatggagctaatggatccactgctgaacagctatcaaatatgtagaaaaggagg
agaacacggataaggttagcgctcagaatatctcattcaaatccatgaataaagtatatgggcgatattctgccgtgtttaaagattccttttga
gaaaaattggcgataagtttcaaactgttgacttcactgattgtcgcactatagatgcaatcaacaagtgtgtagatatctttactgaggggaaa
atcaatccactattggatgaacaattgtctcctagcaattagtgccgtatactttaaagcaaaatggttgacgccattcgaaaaggaatttacca
gtgattatcccttttacgtatcaccaacggaaatggtagacgtaagtatgatgtctatgtacggcgagctatttaatcacgcatctgtaaaagaat
cattcggtaacttttcaatcatagaactgccatatgttggagatactagtatgatggtcattcttccagacaagattgatggattagaatccataga
acaaaatctaacagatacaaattttaagaaatggtgtaactctctggaagctacgtttatcgatgttcacattcccaagtttaaggtaacaggctc
gtataatctggtggatactctagtaaagtcaggactgacagaggtgttcggttcaactggagattatagcaatatgtgtaatttagatgtgagtgt
cgacgctatgatccacaaaacgtatatagatgtcaatgaagagtatacagaagcagctgcagcaacttgtgcactggtgtcagactgtgcat
caacaattacaaatgagttctgtgtagatcatccgttcatctatgtgattaggcatgttgatggaaaaattttttttcgttggtagatattgctctccga
caactaattgttaaccatttttttaaaaaaatagaaaaaacatgtggtattagtgcaggtcgttattcttccaattgcaattggtaagatgacggcc
aactttagtacccacgtcttttcaccacagcactgtggatgtgacagactgaccagtattgatgacgtcaaacaatgtttgactgaatatatttatt
ggtcgtcctatgcataccgcaacaggcaatgcgctggacaattgtattccacactcctctcttttagagatgatgcggaattagtgttcatcgac
attcgcgagctggtaaaaaatatgccgtgggatgatgtcaaagattgtgtagaaatcatccgttgttatataccggatgagcaaaaaaccatca
tcggactttgtgcatatgctgctacttactggggaggtgaagaccatcccactagtaacagtctgaacgcattgtttgtgatgcttgagatgcta
aattacgtggattataacatcatattccggcgtatgaattgatgagttgtacatcttgacatttcttctttcttctcttctcccttttcccagaaacaaa
cttttttacccactataaaataaaatgagtatactacctgttatatttctttctatattttttattcttcattcgttcagactttaacgcgcctgaatgtat
cgacaaagggcaatatttgtcatcattcatggagttagaaaacgagccagtaatcttaccatgtcctcaaataaatacgctatcatccggatata
atatattagatatttatgggaaaaacgaggagcggataatgatagaattataccgatagataatggtagcaatatgctaattctgaacccgaca
caatcagactctggtatttatatatgcattaccacgaacgaaacctactgtgacatgatgtcgttaaatttgacaatcgtgtctgtctcagaatcaa
atatagatcttatctcgtatccacaaatagtaaatgagagatctactggcgaaatggtatgtcccaatattaatgcatttattgctagtaacgtaaa
cgcagatatatatggagcgggcatcgacgccttagaaataagagacttaaacaacggacacctggaattattaccatagaagatgttagaa
aaaatgatgctggttattatacatgtgtttttagaatatatatacggtggcaaaacatataacgtaaccagaattgtaaaattagaggtacgggata
```

Fig. 58 (cont'd)

aaataataccttctactatgcaattaccagaaggtgttgtaacttcaataggtagtaatttgactattgcgtgtagagtatcgttgagacctcccac aacggatgcagacgtcttttggataagtaatggtatgtattacgaagaagatgatggggacggagacggtagaataagtgtagcaaataaaa tctatatgaccgataagagacgtgttattacatcccggttaaacattaatcctgtcaaggaagaagatgctacaacgtttacgtgtatggcgttta ctattcctagcatcagcaaaacagttactgttagtataacgtgaatgtatgttgttacatttccatgtcaattgagtttataagaatttttatacattatc ttccaacaaacaattgacgaacgtattgctatgattaactcccacgatactatgcatattattaatcattaacttgcagactatacctagtgctatttt gacatactcatgttcttgtgtaattgcggtatctatattattaaagtacgtaaatctagctatagtttattatttaattttagataatataccgtctcctta tttttaaaaattgccacatcctttattaaatcatgaatgggaatttctatgtcatcgttaatatattgtgaacaacaagagcagatatctataggaaa gggtggaatgcgatacattgatctatgtagttttaaaacacacgcgaactttgaagaatttatataaatcattccatcgatacatccttctatgttga catgtatatatccaggaattcttttattaatgtcaggaaatgtataaactaaaacattgcccgaaagcggtgcctctatctgcgttatatccgttctt aacttacaaaatgtaaccaataccttttgcatgacttgtttgttcggcaacgttagtttaaacttgacgaatggattaattacaatagcatgatccg cgcatcattaagtttttttactttaacgcccttgtatgtttttacagagactttatctaaatttctagtgcttgtatgtgttataaatataacgggatata gaactgaatcacctaccttagatacccaattacattttatcagatccagataataaacaaattttgtcgccctaactaattctatattgttatatatttt acaattggttatgatatcatgtaataacttggagtctaacgcgcatcgtcgtacgtttatacaattgtgatttagtgtagtatatctacacatgtatttt tccgcactatagtattctggactagtgataaaaactatcgttatatctgtcttcaatgaactcatcgagatattgctctctgtcatattcatacacctgc ataaactttctagacatcttacaatccgtgttattttaggatcatatttacatatttacgggtatatcaaagatgttagattagttaatgggaatcgtct ataataatgaatattaaacaattatatgaggactttaccacaaagcatcataaaaatgagtcgtcgtctgatttatgtttaaatatcaaccgcga atcaactcataaaatacaagagaatgaaatatatacatattttagtcattgcaatatagaccatacttctacagaacttgattttgtagttaaaaact atgatctaaacagacgacaacctgtaactgggtatactgcactacactgctatttgtataataattactttacaaacgatgtactgaagatattatt aaatcatggagtggatgtaacgatgaaaaccagtagcggacgtatgcctgtttatatattgcttactagatgttgtaatatttcacatgatgtagt gatagatatgatagacaaagataaaaaccacttatcgcatagagactattccaacctactactagagtatataaaatctcgttacatgttattgaa ggaagaggatatcgatgagaacatagtatccactttattagataagggaatcgatcctaactttaaacaagacggatatacagcgttacattatt attatttgtgtctcgcacacgtttataaaccaggtgagtgtagaaaaccgataacgataaaaaaggccaagcgaattatttctttgtttatacaac atggagctaatctaaacgcgttagataattgtggtaatacaccattccatttgtatcttagtattgaaatgtgtaataatattcatatgactaaaatg ctgttgacttttaatccgaatttcaaaatatgtaataatcatggattaacgcctatactatgttatataacttccgactacatacaacacgatattctt gttatgttaatacatcactatgaaacaaatgttggagaaatgccgatagatgagcgtcgtataatcgtattcgagtttatcaaaacatattctaca cgtccggcagattcgataacttatttgatgaataggtttaaaaatatagatatttatacccgctatgaaggaaagacattattacacgtagcatgt gaatataataatacacacgtaatagattatcttatacgtatcaacggagatataaatgcgttaaccgacaataacaaacacgctacacaactcat tatagataacaaagaaaattccccatataccattaattgtttactgtatatacttagatatattgtagataagaatgtgataagatcgttggtggatc aacttccatctctacctatcttcgatataaaatcatttgagaaattcatatcctactgtatactttttagatgacacattttacaatagacacgttagga atcgcaattctaaaacgtatcgatacgcattttcaaaatacatgtcgtttgataaatacgatggtataataactaaatgtcataaagaaacaatatt gctcaaactatccactgttctagacactacactatatgcagttttaagatgccataattcgaaaaagttaagaagatacctcaacgagttaaaaa aatataataacgataagtcctttaaaatatattctaatattatgaatgagagataccttaatgtatattataaagatatgtacgtgtcaaaggtatatg ataaactatttcctgttttcacagataaaaattgtctactaacattactaccttcagaaattatatacgaaatattatacatgctgacaattaacgatc tttataatatatcgtatccacctaccaaagtatagttgtattttctcatgcgatgtgtgtaaaaaaactgatattatataaatattttagtgccgtataa tgaagatgacgatgaaaatgatggtacatatatatttcgtatcattattgttattgctattccacagttacgccatagacatcgaaaatgaaatcac agaattcttcaataaaatgagagatactctaccagctaaagactctaaatggttgaatccagcatgtatgttcggaggcacaatgaatgatata gccgctctaggagagccattcagcgcaaagtgtcctcctattgaagacagtctttatcgcacagatataaagactatgtggttaaatgggag aggctagaaaaaatagacggcgacaggtttctaataaacgtgttaaacatggtgatttatggatagccaactatacatctaaattcagtaacc gtaggtatttgtgtaccgtaactacaaagaatggtgactgtgttcagggtatagttagatctcatattaaaaaacctccttcatgcattccaaaaa catatgaactaggtactcatgataagtatggcatagacttatactgtggaattctttacgcaaaacattataataatataacttggtataaagataa taaggaaattaatatcgacgatattaagtattcacaaacgggaaagaaattaattattcataatccagagttagaagatagtggaagatacaact gttacgttcattacgacgacgttagaatcaagatgtaaaatacttacggttataccgtcgcaagaccacaggtttaaactaatactagatccaaa aatcaacgtaacgataggagaacctgccaatataacatgcactgctgtgtcaacgtcattattgattgacgatgtactgattgaatgggaaaat ccatccggatggcttataggattcgattttgatgtatactctgttttaactagtagaggcggtatcaccgaggcgaccttgtactttgaaaatgtta ctgaagaatatataggtaatacatataaatgtcgtggacacaactattattttgaaaaaacccttacaactacagtagtattggagtaaatacaca

Fig. 58 (cont'd)

atgcatttttatatacattactgaataattattattattattattatatcgtatttgtgctataacgcgactatctaggtatttgtatctcaccgatagagaac
atataaatgtagactctattaaacagttgtgtaaaatatcagatcctaatagatgtggatgtacggctttagaaatgagttcattaaaatatgtgat
atcaacggaacatatttatataattatactattgctgttagtataattattgattccacggaagaactaccaacagttactccaattacaacaacata
taattatactatcgatgatagcactactgaagaactacaagtgactcctcatatggatctccatcgatgatacatgtattaaaatactttccgaata
agtcttttaaatattgtattaattatgaaaaactatgctatgcgagtatgatacgatactagattttatctctagcgagagatgtcgttagaatcattt
atcaacgaatatcgataacatgtgtcatttatacgttaaagtctgtccgtcttctctattgtttagactgtttgtagaatgctgtgatataaacaaact
agtagacacaaatatttaactcatgatgaagttgagaatgatatgctttagctaatataaaaatatattaatccactatatattctagacttgatttaa
aaccgataaactactactacgtactgtataagttaggagcagaccctaattatgtagatgatagaggtaatacttctgcatctatatgtccacttat
gagaaaacgtcatttaataagatgcatcgtgaaaagaaatttattaaagagttggtaaaatatgaaaccgaaagtaaataatataggaaataca
cctctacataactacgtatctcaatatgatatcactctcattcctcatccacaacccattaaaaaatggaaattaaagccctctattagcataaacg
gctacaggtctacctttacaatggcctttccttgtgcccagttcagaccctgtcattgccacgctactaaggactccctgaataccgtggccga
cgtcagacattgtctgactgaatacatcctgtgggtttctcatagatggacccatagagaaagcgcagggtctctctacaggcttctcatctcttt
cagaactgatgcaacggagctctttggtggtgagttgaaggattcacttccgtggagatcattaaatgactccatgaaaaccgccgaagaact
tcgtgcaatcattggactttgtactcaatcagctatcgtctctggaagagtcttcaacgataagtatatcgacatactacttatgctgcgaaagatt
ctgaacgagaacgactatctcaccctcttggatcatatccgcactgctaaatactaaatctccttcatgctctctcactacacttttatcatcttat
gaggaataattagcaccagaatagctatgattgcacatgtattctatgtcgtctactggatgaagatgtgacgtacaaaaaaataaaactaga
aattgaaacgtgtcacaacttatcaaaacatatagatagacgaggaaacaatgcgctacattgttacgtctccaataaatgcgatacagacatt
aagattgttcgactgttactctctcgcggagtcgagagactttgtagaaacaacgaaggattaactccgctaggagcatacagtaagcataga
tacgtaaaatctcagattgtgcatctactgatatccagctattcgaattcctctaacgaactcaagtcgaatataaatgatttcgacttacgtctgct
aaaatacctaattgtggataaacggatacgtccgtccaagaatacgaattatgcaatcaatggtctcggattggtggatatatacgtaacgacg
cctaatccgagaccagaagtattgctatggcttcttaaatcagaatgttacagcaccggttacgtatttcgtacctgtatgtacaacagtgatatg
tgtaagaactctcttcattactatatatcgtctcatagagaatctctatccaaggatgtaattaaatgtttgatcgataacaatgtttccatccaatac
tactggtcttgctcaaccatagatatagagattattaataaaggatgtggacacgtgtagagtatacgacgtcagccctatattagaggcgtatt
atctaaacaagcgatttagagtaaccccatataatgtagacatggaaatcgttaatcttcttattgagagacgtcatactcttgtcgacgtaatgc
gtagtattacttcgtacgattccagagaatataaccactacatcatcgataacattctaaagagatttagacaacaggatgaatccatcgtacaa
gccatactgataaactacttacattacggcgatatggtaagtatacctatcattcaatgcatgttggataagacgacggacaacaactttgttaat
aataatctcgtcgatgtaaacgtcgtaaggtttatcgtggaaaatatggacacgcggctgtaaatcacatatctaacaatggccgtctatgtatg
tacggtctgatattatcgagatttaataattgcgggtatcactgttatgaagatgtatttgatatactaagcaagtacatggatgatatagatatgat
cgataactctactatattacgcggtcgatgtcaataatatacaatttgcaaagcggttattggaatatggagcgagtgtcacgctcgataatcaa
tacggccatccagaaaagcagttaccaaagagaagctagttgatttattactgagttaccatcccactctagagactatgattgacgcatttaat
agagatatacgctatctatatcctgaaccattattcgcctgtatcagatacgccttaatcctagatgatgattttccttctaaagtaagtatgatatc
gccggtcgtcataaggaactaaagcgctatagagcagacattaatagaatgaagaatgcctacatatcaggcgtctccatgtttgatatattatt
taaacgaagcaaacgccacagattgagatacgcaaagaacaatgagaggatcgactccattaaataatttatcatggagtgataatgtcctgt
ttccatggcatattacaaaatcgattccgtccaagatgataaaaacatttaccggcatcataaacacggagtttattttatatgtctcgcataaaca
ttactaaaaaaatatattgttcggtttctttcacatctttaattatgaaaaagtaaatcattatgagatggacgcatcgttcgcgacagtatgtggta
catacctaacgtatttatggacgacggtaagaatgaaggtcacgtttctgtcaacaatgtcgacgcgatcgtgtaacacgactcacaatagaa
tctgtgaatgctctcccgatcatggatgcaaggcatgtgtttcccaaacaaaatgtggaataggatacggagtatccggagacgtcatctgttc
tccgtgtggtctcggaacatattctcacaccgtctcttccgcagataaatgcgaacccgtacccagaaatacctttaactatatcgatgtggaaa
ttaacctgtatccagttaacgacacatcgtgtactcggacgaccactaccggtctcagcgaatccatctcaacgtcggaactaactattactat
gaatcataaagactgcgatcccgtcttcttaataaggtagcgacttcaggtttctttacaggagaaaggtgtgcactctgaatttcgagattaaat
gcaataacaaagattcttcctccaaacagttaacgaaagcaaagaatgatactatcatgccgcattcggagacagtaactctagcgtcgacat
ctatatactatatagtaataccaatactcaagactacgaaactgatacaatctcttatcatgtgggtaatgtagccatatgcccggtagttgcgat
atacataaactgatcactaattccaaacccacccgctttttatagtaagtttttcacccataaatacaataattaatttctcgtaaaagtagaaaata
tattctaatttattgcacggtaaggaagtagaatcataaagaacagtactcaatcaatagcaatcatgaaacaatatatcgtactggcatgcatg
tgcctgccagtcttcagcaatcatcctcatcgtgtacggaagaagaaaacaaacatcatatgggaatcgatgttattatcaaagtcacaaagc

Fig. 58 (cont'd)

aagaccaaacaccgaccgatgataagatttgccaatccgtaacggaaattacagagtccgagtcagatccagatcccgaggtggaatcagt
cgaggatgtagatcctcctaccacttattactccatcatcggtggaggtctgagaatgaactttggattcaccaaatgtcctcagattaaatccat
ctcagaatccgctgatggaaagactgtgaggtgtctatcgacatcagatgtagcgaagaagagaaagacagcgacatcaagacccatcca
gtactcgggtctaacatctctcataagaaagtgagttacgaagatatcatcggttcaacgatcgtcgatacaaaatgtgtcaagaatctagagtt
tagcgttcgtatcggagacatgtgcaaggaatcatctgaacttgaggtcaagtatgtcgacggatcggcatctgaaggtgcaaccgatgata
cttcactcatcgattcaacaaaactcaaagcgtgtgtctgaatcgataactctattcatctgaaattggatgagtagggttaatcgaacgattcag
gcacaccacgaattaaaaaagtgtaccggacactatattccggtttgcaaaacaaaaagttacctctcgcgacttcttctttttctgtctcaatag
tgtgatacgattatgacactattcctatttcctttcagggtatcacaaaaatattaaacctctttctgatggtctcatacaaaaatatttttattctctttc
tctctttgatggtctcataaaaaatattttattctctttctctctttgatggtctcataaaatattttattctctttctctctttgatggtctcataaaaaata
tttttattctctttctctctttgatggtctcataaaatattttattctctttctctctttgatggtctcataaaaaatattttattctctttctctctttgatggtc
tcataaaa

Fig. 59 ttttatgagaccatcaaagagagaaagagaataaaaatattttttatgagaccatcaaagagagaaagagaataaaaatattttatgagaccat
caaagagagaaagagaataaaaatattttttatgagaccatcaaagagagaaagagaataaaaatattttatgagaccatcaaagagagaaa
gagaataaaaatattttttatgagaccatcaaagagagaaagagaataaaaatattttgtatgagaccatcagaaagagggtttaatattttgtg
ataccctgaaaggaaataggaatagtgtcataatcgtatcacactattgagacagaaaaagaagaagtcgcgagaggtaactttttgttttgca
aaccggaatatagtgtccggtacactttttaattcgtggtgtgcctgaatcgttcgattaaccctactcatccaatttcagatgaatagagttatc
gattcagacacacgctttgagttttgttgaatcgatgagtgaagtatcatcggttgcaccttcagatgccgatccgtcgacatacttgacctcaa
gttcagatgattccttgcacatgtctccgatacgaacgctaaactctagattcttgacacattttgtatcgacgatcgttgaaccgatgatatcttc
gtaactcactttcttatgagagatgttagacccgagtactggatgggtcttgatgtcgctgtctttctcttcttcgctacatctgatgtcgatagaca
cctcacagtctttccatcagcggattctgagatggatttaatctgaggacatttggtgaatccaaagttcattctcagacctccaccgatgatgg
agtaataagtggtaggaggatctacatcctcgactgattccacctcgggatctggatctgactcggactctgtaatttccgttacggattggca
aatcttatcatcggtcggtgtttggtcttgctttgtgactttgataataacatcgattcccatatgatgtttgttttcttcttccgtacacgatgaggat
gattgctgaagactggcaggcacatgcatgccagtacgatatattgtttcatgattgctattgattgagtactgttctttatgattctacttccttacc
gtgcaataaattagaatatattttctactttacgagaaattaattattgtatttatgggtgaaaaacttactataaaaagcgggtgggtttggaatta
gtgatcagtttatgtatatcgcaactaccgggcatatggctacattacccacatgataagagattgtatcagtttcgtagtcttgagtattggtatt
actatatagtatatagatgtcgacgctagagttactgtctccgaatgcggcatgatagtatcattctttgctttcgttaactgtttggaggaagaat
ctttgttattgcatttaatctcgaaattcagagtgcacacctttctcctgtaaagaaacctgaagtcgctaccttattaagaagacgggatcgcag
tctttatgattcatagtaatagttagttccgacgttgagatggattcgctgagaccggtagtggtcgtccgagtacacgatgtgtcgttaactgga
tacaggttaatttccacatcgatatagttaaaggtatttctgggtacgggttcgcatttatctgcggaagagacggtgtgagaatatgttccgag
accacacggagaacagatgacgtctccggatactccgtatcctattccacattttgtttgggaaacacatgccttgcatccatgatcgggaga
gcattcacagattctattgtgagtcgtgttacacgatcgcgtcgacattgttgacagaaacgtgaccttcattcttaccgtcgtccataaatacgtt
aggtatgtaccacatactgtcgcgaacgatgcgtccatctcataatgatttactttttcataattaaagatgtgaaagaaaaccgaacaatatattt
ttttagtaatgtttatgcgagacatataaaataaactccgtgtttatgatgccggtaaatgttttttatcatcttggacggaatcgattttgtaatatgcc
atggaaacaggacattatcactccatgataaattatttaatggagtcgatcctctcattgttctttgcgtatctcaatctgtggcgtttgcttcgttta
aataatatatcaaacatggagacgcctgatatgtaggcattcttcattctattaatgtctgctctatagcgctttagttccttatgacgaccggcga
tatcatacttactttagaaggaaaatcatcatctaggattaaggcgtatctgatacaggcgaataatggttcaggatatagatagcgtatatctct
attaaatgcgtcaatcatagtctctagagtgggatggtaactcagtaataaatcaactagcttctctttggtaactgcttttctggatggccgtatt
gattatcgagcgtgacactcgctccatattccaataaccgctttgcaaattgtatattattgacatcgaccgcgtaatatagtagagttatcgatc
atatctatatcatccatgtacttgcttagtatatcaaatacatcttcataacagtgatacccgcaattattaaatctcgataatatcagaccgtacata
catagacggccattgttagatatgtgatttacagccgcgtgtccatattttccacgataaaccttacgacgtttacatcgacgagattattattaac
aaagttgttgtccgtcgtcttatccaacatgcattgaatgataggtatacttaccatatcgccgtaatgtaagtagtttatcagtatggcttgtacga
tggattcatcctgttgtctaaatctctttagaatgttatcgatgatgtagtggttatattctctggaatcgtacgaagtaatactacgcattacgtcga
caagagtatgacgtctctcaataagaagattaacgatttccatgtctacattatatgggggttactctaaatcgcttgtttagataatacgcctctaat
atagggctgacgtcgtatactctacacgtgtccacatcctttattaataatctctatatctatggttgagcaagaccagtagtattggatggaaac
attgttatcgatcaaacatttaattacatccttggatagagattctctatgagacgatatatagtaatgaagagagttcttacacatatcactgttgt
acatacaggtacgaaatacgtaaccggtgctgtaacattctgatttaagaagccatagcaatacttctggtctcggattaggcgtcgttacgtat
atatccaccaatccgagaccattgattgcataattcgtattcttggacggacgtatccgtttatccacaattaggtattttagcagacgtaagtcg
aaatcatttatattcgacttgagttcgttagaggaattcgaatagctggatatcagtagatgcacaatctgagatttacgtatctatgcttactgta
tgctcctagcggagttaatccttcgttgtttctacaaagtctctcgactccgcgagagagtaacagtcgaacaatcttaatgtctgtatcgcattta
ttgggagacgtaacaatgtagcgcattgtttcctcgtcatctatatgtttgataagttgtgacacgtttcaatttctagttttattttttttgtacgtcaca
tcttcatccagtagacgacatagaatacatgtgcaatccatagctattctggtgctaattattcctcataagatgataaaaagtgtagtgagaga
gcatgaaggagatttagtatttagcagtgcggatatgatccaagagggtgagatagtcgttctcgttcagaatctttcgcagcataagtagtat

Fig. 59 (cont'd)

gtcgatatacttatcgttgaagactcttccagagacgatagctgattgagtacaaagtccaatgattgcacgaagttcttcggcggttttcatgg
agtcatttctgatgaaacatttaatgatctaaatttcagtttatgtttgtaccccgtattcatacttaacaaattggtattacataccattaataatgcaa
gcataaaaaatcgttagtagatgtttctaaatataggttccgtaagcaaagaatataagaatgaagcggtaatgataaaatcaatcgttatctaa
aatgatcatactcatttattttattctattatattaacacatacatttttaacagcaacacattcaatattgtattgttattttttatattatttacacaattaac
aatatattattagtttatattactgaattaataatataaaattcccaatcttgtcataaacacacactgagaaacagcataaacacaaaatccatca
aaaatgttgataaattatctgatgttgttgttcgctgctatgataatcagatcattcgccgatagtggtaacgctatcgaaacgacatcgccagaa
attacaaacgctacaacagatattccagctatcagattatgcggtccagagggagatggatattgtttacacggtgactgtatccacgctagag
atatcgacggtatgtattgtagatgctctcatggttatacaggcattagatgtcagcatgtagtattagtagactatcaacgttcagaaaaaccaa
acactacaacgtcatatatcccatctcccggtattatgcttgtattagtaggcattattattattacgtgttgtctattatctgtttataggttcactcga
cgaactaaactacctatacaagatatggttgtgccataattttataaatttttttatgagtattttacaaaaatgtataaagtgtatgtcttatgtata
tttataaaaatgctaaatatgcgatgtatctatgttatttgtatttatctaaacaatacctctacctctagatattatacaaaaattttttatttcggcatat
taaagtaaaatctagttaccttgaaaatgaatacagtgggtggttccgtatcaccagtaagaacataatagtcgaatacagtatccgattgagat
tttgcatacaatactagtctagaaagaaatttgtaatcatcttctgtgacgggagtccatatatctgtatcatcgtcccatgctatattcctgttatca
tcattagttaatgaaaataactctcgtgcttcagaaaagtcaaatattgtatccatacatacatctccaaaactatcgcttatacgtttatctttaacg
atacctatacctagatggttatttactaacagacattttccagatctattgactataactcctatagtttccacatcaaccaagtaatgatcatctatt
gttatataacaataacataactcttttccgttttatcagtatgtatatctatatcaacgtcgtcgttgtagtgaatagtagtcattgatctattatatga
aacggatatgtctagaacggcaattgttttacgtccagttaacactttcgttgatttaaagtctagagtctttgcaaacataatatccttatccgact
ttatatttcctgtaggggtggtataatttttattttgcctccacatatcggtgtttccaaatatattactagacaatattccatatagttattagttaagggt
acccaattagaacacgtacgcttattatcatcatttggatcgtatttcataaaagttattgtactatcgatgtcaacacattctacatttttaatcgtct
atatagtattttctgatattttctataatatcagaattgtcttccatcggaagttgtatactatcggaatcagttacatgtttaaataattctctgatgtc
attccttatacaatcaaattcattattaaacagtttaatagtctgtagacctttatcgtcgtaaatatccattgtcttattagttacgcttattttatgtgtt
tttacgttgctttattatattttataagaatgattgtttgacgaatcacgagaactattaagacacattattaggtatatattataaaaaagttttgatta
cgatgttataagaggaaagaggacacattaacatcatacatcaattaactacattcttataacatcgtaatcaaaagaattgcaattttgatgtata
acaactgtcaatgggttatggaattgtatattacatattatacggtatgttggtaacgacaaataccgatcggtaattgtctgccggtgtaataga
attatatatatctatctattacaccggccttgtatacataataataagttgtggtagtatgatctccatatttataatttaggactttgtattcagttttttt
ggaatcataaaaaataaaaaaaagtttttactaatttaaaattatttacatttttttcactgtttagtcgcgcggatatggaattcgatcctgccaaaatca
atacatcatctatagatcatgtaacaatattacaatacatagatgaaccaaatgatataagactaacagtatgcattatcacaaaaaataaatccac
atttggctaatcaatttcgggcttggaaaaaacgtatcgccggaaggggactatatgactaacttatctagagatacaggaatacaacaatcaaa
acttactgaaactgtcaaaaaaatagaaacatatatggtctatatatacactacaatttagttattaattggataaccgatgtgattatcaatcaata
ttaagaaggttggtaaattggtacatagctaataatacctatacacccaataatacaacaaccatttctgagttggatatcatcaaaatactggat
aaatacgaggacgtgtatagagtaagtaaagaaaaagaatgtgaaatttgctatgaagttgtttactcaaaacgatagatactttggttattgg
attcgtgtaatcatatattttgcataacatgcatcaatatatggcatagaacacgaagagaaaccggtgcgtcggataattgtcctatatgtcgta
cccgtttagaaacataacaatgagcaagttaactaataaataaaaagtttaatttgttgacgacgtatgtcgttattttttctcgtataaaagattaa
tttgattctaatataatctttagtattggataaatatcaattcaaattaattccattagattatatcataaataaaaatagtagcacgcactacttcagc
caaatattctttttgaaacgccatctatcgtagtgaggacacaagtgaacctataatgagcaaatttattagtatcggttacatgaaggactttac
gtagagtggtgattccactatctgtggtacgaacggtttcatcttctttgatgccatcacccagatgttctataaacttggtatcctttgccaacca
atacatatagctaaactcaggcatatgttccacacatcctgaacaatgaaattctccagaagatgttacaatgtctagatttggacatttggtttca
accgcgttaacatatgagtgaacacacccatacatgaaagcgatgagaaataggattttcatcttgccaaaatatcactagaaaaaatttattta
tcaattttaaaggtataaaaaatacttattgttgctcgaatattttgtatttgatggtatacggaagattagaaatgtaggtattatcatcaactgattc
tatggtttatgtattctatcatgtttcactattgcgttggaaataatatcatatgcttccacatatattttattttgtttaactcataatactcacgtaatt
ctggattattgacatatctatgaataatttttagctccatgatcagtaaatattaatgagaacatagtattaccacctaccattattttttcatctcattc

Fig. 59 (cont'd)

aattcttaattgcaaagatctatataatcattatagcgttgacttatggactctggaatcttagacgatgtacagtcatctataatcatggcatattta
atacattgttttatagcatagtcgttatctacgatgttagatatttctctcaatgaatcaatcacacaatctaatgtaggtttatgacataatagcatttt
cagcagttcaatgttttttagattcgttgatggcaatggctatacatgtatatccgttatttgatctaatgttgacatctgaaccggattctagcagta
aagatactagagattgtttattatatctaacagccttgtgaagaagtgtttctcctcgtttgtcaatcatgttaatgtctttaagataaggtaggcaa
atgtttatagtactaagaattgggcaagcataagacatgtcacaaagaccctttttgtatgtataagtgtaaaaattataacattcatagttggattt
acataggtgtccaatcgggatctctccatcatcgagataattgatggcatctcccttccttttttagtagatatttcatcgtgtaagaatcaatatta
atatttctaaagtatccgtgtatagcctctttatttaccacagttccatattccactagagggatatcgccgaatgtcatatactcaattagtatatgt
tggaggacatccgagttcattgttttcaatatcaaaaagatggtttccttatcatttctccatagtggtacaatactacacattattccgtgcggcttt
ccattttccaaaaacaatttgaccaaatctacatctttattgtatctataatcactatttagataatcagccataattactcgagtgcaacatgttaga
tcgtctatatatgaataagccgtgttatctattcctttcattaacaatttaacgatgtctatatctatatgagatgacttaatataatattgaagagctgt
acaatagtttttatctataaaagacggcttgattccgtgattaattagacatttaacaacttccggacgcacatatgctctcgtatccgactctgaa
tacagatgagagatgatatacagatgcaatacggtaccgcaatttcgtagttgataatcatcatacgcgtatcagtactcgtcctcataaagaa
cactgcagccattttctatgaacaaatcaataatttcaggaacaggatcatctgtcattacataatttctataactgaacgatggttttcacatttaa
cactcaagtcaaatccatgttctaccaacacctttatcaagtcaacgtctacattttggatttcatatagctgaatatattaaagtcatttatgttgct
aaatccagtggcttctagtagagccatcgctatatcctttaactttaacatgtctactatttgtgtattcttctaatggggtagctgtctccaattttg
cgtaatggattagtgccactgtctagtagtagtttgacgacctcgacattattacaatgctcattaaaaaggtatgcgtgtaaagcattattcttga
attggttcctggtatcattaggatctctgtctctcaacatctgtttaagttcatcgagagccacctcctcattttccaaatagtcaaacattttgactg
aatgagctactgtgaactctatacacccacacaactaatgtcattaaatatcatgtcaaaaacttgtacaattattaataaaaataatttagtgttta
aattttaccagttccagattttacacctccgttaacccacacttttacaccactggacgatcctcctccccacattccaccgccaccagatgtata
agtttagatcctttattactaccatcatgtccatggataaagacactccacatgccgccactacccctttagaagacatattaataagacttaa
ggacaagtttaacaataaaattaatcacgagtaccctactaccaacctacactattatatgattatagtttctattttacagtaccttaactaaagtc
tctagtcacaagagcaatactaccaacctacactattatatgattatagtttctattttataggaacgcgtacgagaaaatcaaatgtctaatttct
aacggtagtgttgataaacgattatcgtcaatggatacctcctctatcatgtcgtctattttcttactttgttctattaacttattagcattatatattattt
gattataaaacttatattgcttattagcccaatctgtaaatatcggattattaacatatcgtttctttgtaggtttatttaacatgtacatcactgtaagc
atgtccgtaccatttattttaatttgacgcatatccgcaatttctttttcgcagtcggttataaattctatatatgatggatacatgctacatgtgtactt
ataatcgactaatatgaagtacttgatacatattttcagtaacgatttattattaccacctatgaataagtacctgtgatcgtctaggtaatcaactgt
tttcttaatacattcgatggttggtaatttactcagaataatttccaatatcttaatatataattctgctatttctgggatatatttatctgccagtataac
acaaatagtaatacatgtaaacccatattttgttattatattaatgtctgcgccattatctattaaccattctactaggctgacactatgcgacttaat
acaatgataaagtatactacatccatgtttatatcatcaatatacggcttacaaagttttagtatcgataacacatccaactcacgcatagagaag
gtagggaataatggcataatatttattaggttatcatcattgtcattatctacaactaagtttccattttttaaaatatactcgacaactttaggatctct
attgccaaattttgaaaatatttatttatatgcttaaatctatataatgtagctccttcatcaatcatacatttaataacattgatgtatactgtatgata
agatacatattctaacaatagatcttgtatagaatctgtatatcttttaagaattgtggatattattacgtaaactattacacaattctaaaatataaaa
cgtatcacggtcgaataatagttgatcaactatataattatcgattttgtgatttttcttcctaaactgtttacgtaaatagttagatagaatattcatta
gttcatgaccactatagttactatcgaataacgcgtcaaatatttcccgtttaatatcgcatttgtcaagataataatagagtgtggtatgttcacga
taagtataataacgcatctcttttcgtgtgaaattaaatagtttattacgtccaaagatgtagcataaccatcttgtgacctagtaataatataataa
tagagaactgtttacccattctatcatcataatcagtggtgtagtcgtaatcgtaattgtctaattcatcatcccaattataatattcaccagcacgt
ctaatctgttctattttgatcttgtatccatactgtatgttgctacatgtaggtattcctttatccaataatagtttaaacacatctacattgggatttgat
gttgtagcgtattttctacaatattaataccattttgatactatttatttctatacctttcgaaattagtaatttcaataagtctatatcgatgttatcaga
acatagatattcgagtatatcaaaatcattgatattttatagtcgactgacgacaataacaaaatcacaacatcgtttttgatattattattttttcttg
gtaacgtatgcctttaatggagtttcaccatcatactcatataatggatttgcaccactttctatcaatgattgtgcactgctggcatcgatgttaaa
tgttttacaactatcatagagtatcttatcgttaaccatgattggttgttgatgctatcgcatttttggtttctttcatttcagttatgtatggatttagca

Fig. 59 (cont'd)

cgtttgggaagcatgagctcatatgatttcagtactgtagtgtcagtactattagtttcaataagatcaatctctagatctatagaatcaaaacacg
ataggtcagaagataatgaatatctgtaggcttcttgttgtactgtaacttctcgttttgttagatgtttgcatcgtgctttaacatcaatggtacaaa
tttttatcctcgctttgtgtatcatattcgtccctactataaaattgtatattcagattatcatgagatgtgtatacgctaacggtatcaataaacggag
cacaccatttagtcataaccgtaatccaaaaatttttaaagtatatcttaacgaaagaagttgtgtcattgtctacggtgtatggtactagatcctc
ataagtgtatatatctagagtaatgtttaatttatcaaatggttgataatatggatcctcatgacaatttccgaagatggaaatgagatatagacat
gcaataaatctaattgcggacatggttactccttaaaaaaaatacgaataatcaccttggctatttagtaagtgtcatttaacactatactcatattaa
tccatggactcataatctctatacgggattaacggatgttctatatacggggatgagtagtttcttcttttaactttatactttttactaatcatatttag
actgatgtatgggtaatagtgtttaaagagttcgttctcatcatcagaataaatcaatatctctgttttttttgttatacagatgtattacagcctcatat
attacgtaatagaacgtgtcatctaccttattaactttcaccgcatagttgtttgcaaatacggttaatcctttgacctcgtcgatttccgaccaatct
gggcgtataatgaatctaaactttaatttcttgtaatcattcgaaataattttttagtttgcatccgtagttatcccctttatgtaactgtaaatttctcaa
cgcgatatctccattaataatgatgtcgaattcgtgctgtatacccatactgaatggatgaacgaataccgacggcgttaatagtaatttacttttt
catctttacatattgggtactagtttactatcataagtttataaattccacaagctactatggaataagccaaccatcttagtataacacacatgtct
taaagtttattaattaattacatgttgtttatatatcgctacgaatttaaacagagaaatcagtttaggaaaaaaaaatatctatctacatcatcacg
tctctgtattctacgatagagtgctactttaagatgagacatatccgtgtcatcaaaaatatactccattaaaatgattattccggcagcgaacttg
atattggatatatcacaacctttgttaatatctacgacaatagacagcagtcccatggttccataaacagtgagtttatctttctttgaagagatattt
tgtagagatcttataaaactgtcgaatgacatcgcatttatatctttagctaaatcgtatatgttaccatcgtaatatctaaccgcgtctatcttaaac
gtttccatcgctttaaagacgtttccgatagatggtctcatttcatcagtcatactgagccaacaaatataatcgtgtataacatctttgatagaatc
agactctaaagaaaacgaatcggctttattatacgcattcatgataaacttaatgaaaaatgttttttcgttgtttaagttggatgaatagtatgtctta
ataattgttattatttcattaattaatatttagtaacgagtacactctataaaaacgagaatgacataactagttatcaaagtgtctaggacgcgtaa
ttttcatatggtatagatcctgtaagcattgtctgtattctggagctattttctctatatctaatttctgaacgttcaccaatgtctctagccactttggc
actaatagcgatcattcgcttagcgtcttctatattattaactggttgattcaatctatctagcaatggaccgtcggacagcgtcattctcatgttctt
aatcaatgtacatacatcgccgtcatctaccaattcatccaacaacataagcttttaaaatcatcattataataggtttgatcgttgtcatttctcca
aagaatatatctaataagtagagtcctcatgattagttaacaactatttttatgttaaatcaattagtacaccgctatgtttaatacttattcatatttta
gtttttaggattgagaatcaatacaaaaattaatgcatcattaattttagaaatacttagtttccacgtagtcaatgaaacatttgaactcatcgtac
aggacgttctcgtacaggacgtaactataaaccggtttatatttgttcaagatagatacaaatccgataactttttttacgaattctacgggatcca
ctttaaaagtgtcataccgggttctttttatttttttaaacagattaatggtgtgatgttgattaggtcttttacgaatttgatatagaatagcgtttacat
attctccataatggtcaatcgccatttgttcgtatgtcataaattctttaattatatgacactgtgtattatttagttcatccttgttcatcattaggaatct
atccaatatggcaattatactagaactataggtgcgttgtatacacatattgatgtgtctgtttatacaatccatgctactaccttcgggtaaaattg
tagcatcatataccatttctagtactttaggttcattgttatccattgcagaggacgtcatgaacgcatcctaaaaaaatatattattttttatgttatttt
gttaaaaataatcatcgaatacgaatcatccagtccactgaatagcaaaatctttactattttggtatcttccaatgtggctgcctgatgtaatgga
aattcattctctagaagattttttcaatgctccagcgttcaacaacgtacatactagacgcacgttattatcagctattgcataatacaaggcactat
gtccatggacatccgccttaaatgcatctttgctagagagaaagcttttcagctgcttagacttccaagtattaattcgtgacagatccatgtctg
aaacgagacgctaattagtgtataattttttgtcatattgcaccagaattaataatatctctaatagatctgattagtagatacatggctatcgcaaa
acaacatatacacatttaataaaaataatatttattaagaaaattcagatttcacgtacccatcaatataaataaaataatgattccttacaccgtac
ccatattaaggagattctaccttacccataaacaatataaatccagtaatatcatgtctgatgatgaacacaaatggtgtattaaattccagtttttc
aggagatgatctcgccgtagctaccataatagtagatgcctctgctacagttccttgttcgtcgacatctatctttgcattctgaaacattttataaa
tatataatgggtccctagtcatatgtttaaacgacgcattatctggattaaacatactaggagccatcatttcggctatcgacttaatatccctctta
ttttcgatagaaaatttaggggagtttaagattgtacactttattccctaattgaaacgaccaatagtctaattttgcagccgtaatagaatctgtgaa
atgggtcatattatcacctattgccaggtacatactaatattagcatccttatacggaaggcgtaccatgtcatattctttgtcatcgattgtgattgt
atttccttgcaatttagtaactacgttcatcatgggaaccgttttcgtaccgtacttattagtaaaactagcattgcgtgtttagtgatatcaaacgg
atattgccatataccctttaaaatatatagtattaatgattgcccatagagtattattgtcgagcatattagaatctactacattagacataccggatct

Fig. 59 (cont'd)

acgttctactatagaattaattttattaaccgcatctcgtctaaagtttaatctatataggccgaatctatgatattgttgataatacgacggtttaata
cacacagtattatctacgaaactttgataagttagatcagtgtacgtatatttagatgttttcagcttagctaatcctgatattaattctgtaaatgctg
gacccagatctcttttctcaaatccatagtcttcaataattctattctagtattacctgatgcaggcaatagcgacataaacatagaaaacgaata
accaaacggtgagaagacaatattatcatcttgaatattttatacgctactataccggcattggtaaatccttgtagacgataggtagacgctg
aacacgttaacgatagtatcaataacgcaatcatgattttatggtattaataattaaccttatttttatgttcggtataaaaattattgatgtctacaca
tcctttgtaattgacatctatatatcctttgtataatcaactctaatcactttaactttacagttttccctaccagtttatccctatattcaacatatcta
tccatatgcatcttaacactctctgccaagatagcttcagagtgaggatagtcaaaaagataaatatatagagcataatcattctcgtatactctg
ccctttattacatcgcccgcattgggcaacgaataacaaaatgcaagcatcttgttaacgggctcgtaaattgggataaaaattatgttttatat
ctattttattcaagagaatattcaggaatttctttttccggttgtatctcatcgcagtatatatcatttgtacattgtttcatattttttaatagtttacacctt
ttagtaggactagtatcgtacaattcatagctgtattttgaattccaatcacgcataaaaatatcttctaattgttgacgaagacctaatccatcatc
cggtgtaatattaatagatgctccacatgtatccgtaaagtaatttcctgtccaatttgaggtacctatataggccgtttatcggttaccatatattt
ggcatggtttaccctagaatacggaatggggaggatcagcatctggtacaataaatagctttacttctatatttatgtttttagatttagcatagcg
atagatcttaaaaagtttctcatgataaacgaagatcgttgccagcaactaatcaatagcttaacggatacttgtctgtctatagcggatcttctta
attcatcttctatataaggccaaaacaaaattttacccgccttcgaataaataatagggataaagttcataacagatacataaacgaatttactcg
catttctaatacatgacaataaagcggttaaatcattggttctttccatagtacatagttgttgcggtgcagaagcaataaatacagagtgtggaa
caccacttacgttaatactaagaggatgatctgtattataatacgacggataaaagtttttccaattatatggtagattgttaactccaagatacca
gtatacctcaaaaatttgagtgagatccgctgccaagttcctattattgaagatcgcaatacccaattctttgacctgagttagtgatctccaatcc
atgttagcgcttcctaaataaatatgtgtattatcagatatccaaaattttgtatgaagaactcctcctaggatatttgtaatatctatgtatcgtactt
caactccggccatttgtagtctttcaacatcctttaatggtttgttagatttattgacggctactctaactcgtactcctcttttgggtaattgtacaat
ctcgtttaatattatcgtgccgaaattcgtacccacttcatccgataaactccaataaaaagatgatatatctagtgttttgtggtattggatagaa
tttccctccacatgttaaatgtagacaaatatactttatcaaattgcatacctataggaatagtctctgtaatcactgcgattgtattatccggattca
tttatttgttaaaagaataatcctatatcacttcactctattaaaaaatccaagtttctatttctttcatgactgatttttttaacttcatccgtttccttatga
agatgatgtttggcaccttcataaattttttatttctctattacaatttgcatgttgcatgaaataatatgcacctaaaacatcgctaatctcattgtttgt
tccctggagtatgagagtcggggtgttaatcttggaaattattttttctaaccttgttggtagccttcaagacctgactagcaaatccagccttaatt
ttttcatgattgattaatgggtcgtattggtatttataaactttatccatatctctagatactgattctggacatagctttccgactggcgcatttggtgt
gatggttcccataagtttggcagctagcagattcagtcttgaaacagcatctgcattaactagaggagacattagaatcattgctgtaaacaag
tttggattatcgtaagaggctagtatagaaattgttgctcccatggaatgacccaataagtagatttaatagttaccacgtgctgtaccaaagtca
tcaatcatcattttttcaccattacttcttccatgtccaatatgatcatgtgagaatactaaaattcctaacgatgatatgtttttcagctagttcgtcata
acgtccagaatgtttaccagctccatgacttatgaatactaatgccttaggatatgtaatcattgtccagattgaacatacagtttgcactcatgat
tcacgttatataactatcaatattaacagttcgtttgatgatcatattattttttatgtttattgataattgtaaaaacatacaattaaatcaatatagagg
aaggagacggctactgtcttttgtgagatagtcatggcgactaaattagattatgaggatgctgtttttttactttgtggatgatgataaaatatgta
gtcgcgactccatcatcgatctaatagatgaatatattacgtggagaaatcatgttatagtgtttaacaaagatattaccagttgtggaagactgt
acaaggaattgatgaagttcgatgatgtcgctatacggtactatggtattgataaaattaatgagattgtcgaagctatgagcgaaggagacca
ctacatcaattttacaaaagtccatgatcaggaaagtttattcgctaccataggaatatgtgctaaaatcactgaacattggggatacaaaaaga
tttcagaatctagattccaatcattgggaaacattacagatctgatgaccgacgataatataaacatcttgatacttttctagaaaaaaaattgaa
ttgatgatatagggggtcttcataacgcataattattacgttagcattctatatccgtgttaaaaaaaattatcctatcatgtatttgagagtttttatatgt
agcaaacatgatagctgtgatgccaataagctttagatattcacgcgtgctagtgttagggatggtattatctggtggtgaaatgtccgttatata
atctacaaaacaatcatcgcatatagtatgcgatagtagagtaaacatttttatagttttttactggattcatacatcgtctacccaattcggttatga
atgaaattgtcgccaatcttacacccaacccttgttatccattagtatagtattaacttcgttatttatgtcataaactgtaaatgattttgtagatgc
catatcatacatgatattcatgtccctattataatcattactaactttatcacaatatatgttgataatatctatatatgatctagtctttgtgggcaact
gtctatacaagtcgtctaaacgttgtttactcatatagtatcgaacagccatcattacatggtcccgttccgttgatagataatcgagtatgttagt

Fig. 59 (cont'd)

ggacttgtcaaatctatataccatattttctggaagtggatatacatagtcgtgatcaacattattgctagcctcatcttctatatcctgtactatacc
atctacataatctacgatattattacacataaacatcgacaacatactattgtttattatctaagtcctgttgatccaaacccttgatctcctctatttgt
actatctagagattgtacttcttccagttctggataatatatacgttgatagattagctgagctattctatctccagtatttacattaaacgtacatttc
cattattaataagaatgactcctatgtttcccctataatcttcgtctattacaccacctcctatatcaatgcctttagtgacagaccagacctagga
gctattctaccatagcaaatcttaggcatggacatactaatatctgtcttaattaactgtctttctcctggagggatagtataatcgtaagcgctata
caaatcatatccggcagcacccggcgattgcctagtaggagatttagctctgttagtttccttaacaaatctaactggtgagttaatattcatgtt
gaacataaaactaatattttatttcaaaattatttaccatcccatatattccatgaataagtgtgatgattgtacacttctatagtatctatatacgattc
acgataaaatcctcctatcaatagcagtttattatccactatgatcaattctggattatccctcggataaataggatcatctatcagagtccatgtat
tgctggattcacaataaaattccgcatttctaccaaccaagaataaccttctaccgaacactaacgcgcatgatttataatgaggataataagtg
gatggtccaaactgccactgatcatgattgggtagcaaatattctgtagttgtatcagtttcagaatgtcctcccattacgtatataacattgtttat
ggatgccactgctggattacatctaggtttcagaagactcggcatattaacccaagcagcatccccgtggaaccaacgctcaacagatgtgg
gatttggtagacctcctactacgtataatttattgttagcgggtatcccgctagcatacagtctggggctattcatcggaggaattggaatccaat
tgtttgatatataatttacagctatagcattgttatgtatttcattgttcatccatccaccgatgagatatactacttctccaacatgagtacttgtaca
catatggaatatatctataatttgatccatgttcataggatactctatgaatggatacttgtatgatttgcgtggttgtttatcacaatgaaatattttg
gtacagtctagtatccattttacattatttatacctctgggagaaagataatttgacctgattacattttgataaggagtagcagatttcctaatttat
ttcttcgctttatataccacttaatgacaaaatcctcatctggaacatttagttcatcgctttctagaataagtttcatagatagataatcaaaattgtc
tatgatgtcatcttccagttccaaaaagtgtttggcaataaagttttagtatgacataagagattggatagtccgtattctataccatcatgtaac
actcgacacaatattcctttctaaaatctcgtaggataaagtttatacaagtgtagatgataaattctacagaggttaatatagaagcacgtaata
aattgacgacgttatgactatctatatataccttttccagtatatgagtaaataactatagaagttagactgtgaatgtcaaggtctagacaaaccct
cgtaactggatctttatttttcgtgtattttttgacgtaaatgtgtgcgaaagtaaggagataactttttcaatatcgtagaattgactattatattgcct
cctatggcatcaataattgtttttgaatttcttagtcatagacaatgctaatatattcttacagtacacagtattgacaaatatcggcatttatgtttcttt
aaaagtcaacatctaaagaaaaatgattatcttcttgagacataactcccatttttggtattcacccacacgttttcgaaaaaattagtttttacctt
ctaatgatatattttccatgaaatcaaacggattggtaacattataaatttttttaaatcccaattcagaaatcaatctatccgcgacgaattctatat
atgtttcatcatttcacaattcattcctataagttaactggaagagccgcagtaagaaattcttgttcaatggataccgcatctgttataatagatc
taacggtttcttcactcggtggatgcaataaatgtttaaacatcaaacatgcgaagtcgcagtgtagaccctcgtctctactaatcaattcgttgg
aaaacgtgagtccgggcattaggccacgcttttaagccaaaatatggaagcgaatgatccggaaaagaagattccttctactgcagcaaag
gcaataagtctctctccataaccggcgctgtcatgtatccacttttgagcccaatcggccttctttttacacaaggcatcgtttctatggcattaa
agagatagtttttttcattactatctttaacataagtatcgatcaaaagactatacatttccgaatgaatgttttcaatggccatctgaaatccgtaga
aacatctagcctcggtaatctgtacttctgtacaaaatcgttccgccaaattttcattcactattccgtcactggctgcaaaaaacgccaatacat
gttttataaaatattttttcgtctggtgttagtttattccaatcattgatatctttagatatatctacttcttccactgtccaaaatgatgcctctgccttttta
tacatgttccagatgtcatgatattggattgggaaaataacaaatctatttggatttggtgcaaggatgggttccataactaaattaacaataaca
ataaattttttttcagttatctatatgcctgtacttggatctttttgtacatcgatatcgccgcaatcactacaataattacaagtattattgatagcattg
ttattagtactatcataattaaattatcgttattatcattttgtaattgtgacatcatactagatataatcgtttgcgagattgttgtgggaagcgggcat
ggaggatgaattatcgttattattatttaaagcctcccattcggattcacaaatatggcgcgcgttcaacattttatggaaacagataacaagaaa
actcgtcatcgttcaaattttttaacgatagtaaaccgattaaacgtcgagctaatttctaacgctagcgactctgttggatatgggtttccagatat
atatcttttcagttcccctacgtatctataatcatctgtaggaaatggaagatatttccatttatctactgttcctaatatcatatgtggtggtgtagta
gaaccattaagcgcgaaagatgttatttcgcatcgtattttaacttcgcaataatttctggttagataacgcactctaccagtcaagtcaatgatat
tagcctttacagatatattcatagtagtcgtaacgatgactccatcttttagatgcgatactcctttgtatgtaccagaatcttcgtacctcaaactc
gatatatttaaacaagttaatgagatattaacgcgtttatgaatgatgatatataaccagaagtttatcctcggtggctagcgctataaccttatc
attataataccaactagtgtgattaatatgtgacacgttagtgtgggtacaaatatgtacattatcgtctacgtcgtattcgatacatccgcataca
gccaacaaatataaaatgacaaatactctaacgccgttcgtacccatcttgatgcggtttaataaatgttttgatttcaatttattgtaaaaaaagat

Fig. 59 (cont'd)

tcggttttatactgttcgatattctcattgcttatattttcatctatcatctccacacagtcaaatccgtggttagcatgcacctcatcaaccggtaaa agactatcggactcttctatcattataactctagaatatttaatttggtcattattaatcaagtcaattatcttattttaacaaacgtgagtattttactc atttttataaaaacttttagaaatatacagactctatcgtgtgtctatatcttcttttatatccaatgtatttatgtctgattttcttcatttatcatatata atggtccaaattctacacgtgcttcggattcatccagatcattaaggttcttataattgtaacatccttctcttccctcttctacatcttccttcttattct tattcttagcgtcacagaatctaccacagcaggatcccatgacgagcgtcatattaaactaatccattttcaattataatatacgattagtaatgac cattaaaataaaaatattcttcataaccggcaagaaagtgaaaagttcacattgaaactatgtcagtagtatacatcatgaaatgatgatatatat atactctattttggtggaggattatatgatataattcgtggataatcattcttaagacacatttcttcattcgtaaatcttttcacgttaaatgagtgtcc atattttgcaatttcttcatatgatggcggtgtacgtggacgaggctgctcctgttcttgttgtagtcgccgactgtcgtgtctgcgtttagatccct ccattatcgcgattgcgtagatggagtactattttataccttgtaattaaattttttattaattaaacgtataaaaacgttccgtatctgtatttaagag ccagatttcgtctaatagaacaaatagctacagtaaaaataactagaataattgctacacccactagaaaccacggatcgtaatacggcaatc ggttttcgataataggtggaacgtatattttatttaaggacttaacaattgtctgtaaaccacaatttgcttccgcggatcctgtattaactatctgta aaagcatatgttgaccgggcggagccgaacattctccgatatccaatttctgtatatctataatattattaacctccgcatacgcattacagttctt ttctagcttggataccgcactaggtacatcgtctagatctattcctatttcctcagcgatagctcttctatcctttccggaagcaatgaaatcactt caataaatgattcaaccatgagtgtgaaactaagtcgagaattactcatgcatttgttagttattcggagcgcgcaattttaaactgtcctataac ctctcctatatgaatagcacaagtgacattagtagggatagaatgttgagctaattttgtaaataactatctataaaaagattatacaaagttttaa actctttagtttccgccatttatccagtctgagaaaatgtctctcataataaattttccaagaaactaattgggtgaagaatggaaacctttaatct atatttatcacagtctgtttggtacacatgatgaattcttccaatgccgtactaaattcgatatcttttcgatttctggatatgtttttaataaagtatg aacaaagaaatggaaatcgtaataccagttatgtttaacttttgaaattgtttttattttcttgttaatgattccagccacttgggaaaagtcaaagtc gtttaatgccgatttaatacgttcattaaaaacaaacttttatcctttagatgaattattattggttcattggaatcaaaaagtaagatattatcgggt ttaagatctgcgtgtaaaaagttgtcgcagcatggtagttcgtaaattttaatgtataacagagccatctgtaaaaagataaactttatgtattgta ccaaagatttaaatcctaatttgatagctagctcggtatctactttatctgccgaatacagtgctaggggaaaaattataatatttcctctttcgtatt cgtagttagttctcttttcatgttcgaaaaagtgaaacatgcggttaaaatagtttataacattaatattactgttaataactgccggataaaagtgg gatagtaatttcacgaatttgatactgtcctttctctcgttaaacgcctttaaaaaaactttagaagaatatctcaatgatagttcctgaccatccata gtttgtatcaataatagcaacatatgaagaacacgtttatacagagtatgtaaaaatgttaatttatagtttaatcccatggcccacgcacacacg attaattttttttcatctccctttagattgttgtatagaaatttgggtactgtgaactccgccgtagtttccatgggactatataattttgtggcctcgaa tacaaattttactacatagttatctatcttaaagactataccatatcctcctgtagatatgtgataaaaatcgtcgtttataggataaaatcgtttatcc ttttgttggaaaaaggatgaattaatgtaatcattctcttctatctttagtagtgtttccttattaaaattcttaaaataatttaacaatctaactgatgga gcccaatttttggtgtaaatctaattgggacattatattgttaaaatacaaacagtctcctaatataacagtatctgataatctatggggagacatcc attgatattcaggggatgaatcattggcaacacccatttattgtacaaaaagccccaatttacaaacgaaagtccaggtttgatagagacaaac tattaactattttgtctctgtttttaatttctttggtaatgaaattattcacaatatcagtatcttctttatctaccagagattttactaacttgataaccttg gctgtctcattcaataggggtagtaatatttgtatgtgtgatattgatatcttttagaagtgattctttgatggtgccagcatacgaattacaataatgc agaaactcggttaacatgcaggaattatagtaagccaattccaattgttgcctgtgttgtattagagtgtcaatatgagcaatggtgtccttgcgt ttctctgatagaatgcgagcagcgattttggcgttatcatttgacgatatttctggaatgacgaatcctgtttctactaacttttggtaggacaaag tgaaacaatcaagaagatagcttctcctcctatttgtggaagaaattgaactcctctagatgatctccttgacagatattggaccgaattacaga agtacctggaatgtaaagccctgaaacccctcatttttaagcagattgttgccgtaaatcctgcactatgcccaagatagagagctcctttgg tgaatccatctctatgtttcagtttaaccaagaaacagtcagctggtctaaaatttccatctctatctaatacagcatctaacttgatgtcaggaact atgaccggttatgttatatgtaacattgagtaaatccttaagttcataatcatcactgtcatcagttatgtacgatccaaacaatgtttctactggcat agtggatacgaagatgctatccatcagaatgtttccctgattagtattttctatatagctattcttctttaaacgattttccaaatcagtaactatgttc atttttttaggagtaggacgcctagccagtatggaagaggatttctagatcctctcttcaacatctttgatctcaatggaatgcaaaacccata gtgtaacaaccaacgataaaaataatattgttttttcactttttataattttaccatctgactcatggattcattaatatctttataagagctactaacgta taattctttataactgaactgagatatatacaccggatctatggtttccataattgagtaaatgaatgctcggcaataactaatggcaaatgtataa

Fig. 59 (cont'd)

aacaacgaaattatactagagttgttaaagttaatattttctatgagctgttccaataaattatttgttgtaactgcgttcaagtcataaatcatcttga tactatccagtaaaccgttttaagttctggaatattattatcccattgtaaagcccctaattcgactatcgaatatcctgctctgatagcagtttcaa tatcgacggacgtcaatactgtaataaaaggtggtagtattgtcatcatcgtgataaactactggaatatggtcgttagtaggtacggtaactttac acaacgcgatatataactttccttttgtaccattttttaacgtagttgggacgtcctgcagggtattgttttgaagaaatgatatcgagaacagattt gatacgatatttgttggattcctgattatttactataatataatctagacagatagatgattcgataaatagagaaggtatatcgttggtaggataat acatccccattccagtattctcggatactctattaatgacactagttaagaacatgtcttctattctagaaaacgaaaacatcctacatggactcat taaaacttctaacgctcctgattgtgtctcgaatgcctcgtacaaggatttcaaggatgccatagattctttgaccaacgatttagaattgcgttta gcatctgatttttttattaaatcgaatggtcggctctctggtttgctaccccaatgataacaatagtcttgtaaagataaaccgcaagaaaatttata cgcatccatccaaataaccctagcaccatcggatgatattaatgtattattatagatttccatccacagttattgggccagtatactgttagcaac ggtatatcgaatagattactcatgtaacctactagaatgatagttcgtgtactagtcataatatctttaatccaatctaagaaatttaaaattagatttt ttacactgttaaagttaacaaaggtattacccggatacgtggatatcatatatggtattggtccattatcagtaatagctccataaactgatacgg cgatggttttatatgtgtttgatctaacgaggaagaaattcgcgcccacaattcatctctagatatgtatttaatatcaaacggtaacacatcaatt tcgggacgcgtatatgtttctaaattttaatccaaatataatgatgacctatatgccctattatcatactgtcaactatagtacacctagagaactt acgatacatctgtttcctataatcgttaaattttacaaatctataacatgctaaacctttgacgacaaccattcattaatttctgatatggaatctgta ttctcaataccgtatcgttctaaagccagtgctatatctccctgttcgtgagaacgctttcgtataatatcgatcaacggataatctgaagtttttgg agaataatatgactcatgatctatttcgtccataaacaatctagacataggaattggaggcgatgatcttaattttgtgcaatgagtcgtcaatcct ataacttctaatattgtaatattcatcatcgacataacactatctatgttatcatcgtatattagtataccatgaccttcttcatttcgtgccaaaatgat atacagtcttaaatagttacgcaatatctcaatagtttcataattgttagctgtttcatcaaggtttgtatcctgtttaacatgatggcgttctatacgt ttctattttttaaattttttaacgatttactgtggctagatacccaatctctctcaaatattttttttagcctcgcttacaagctgtttatctatactattaaaa ctgacgaatccgtgattttggtaatgggttccgtcgaaatttgccgaagtgatatgaacatattcgtcgtcgactatcaacaattttgtattattctg aatagtgaaaaccttcacagatagatcattttgaacacacaacgcgtctagacttctggcgggttgccatagaatatacgtcgttcttatcccaatt accaactagaagtctgatcttaactcctctattaatggctgcttctataatggagttgtaaatgtcgggccaatagtagctattaccgtcgacacg tgtagtgggaactatggccaaatgttcaatatctatactagtcttagccgacttgagtttatcaataactacatcagtgtctagatctctagaatatc ccaataggtgttccggagaatcagtaaagaacactccacctataggattcttaatatgatacgcagtgctaactggcagacaacaagccgca gagcataaattcaaccatgaatttttgcgctattaaaggctttaaaagtatcaaatcttctacgaagatctgtggccagcggggggataatcaga atatacacctaacgttttaatcgtatgtatagatcctccagtaaatgacgcgtttcctacataacatctttcattatctgacacccaaaaacaaccg agtagtagtcccacattattttttttatctatattaacggttataaaatttatatccgggcagtgactttgtagctctcccagatttcttttccctcgttca tctagcaaaactattattttaatccctttttcagatgcctcttttagtttatcaaaaataagcgctcccctagtcgtactcagaggattacaacaaaa agatgctatgtatatatatttcttagctagagtgataatttcgttaaaacattcaaatgttgttaaatgatcggatctaaaatccatattttctggtagt gtttctaccagcctacattttgctcccgcaggtaccggtgcaaatggccacatttagttaacataaaaacttatacatcctgttctatcaacgattc tagaatatcatcggctatatcgctaaaattttcatcaaagtcgacatcacaacctaactcagtcaatatattaagaagttccatgatgtcatcttcg tctatttctatatccgtatccattgtagattgttgaccgattatcgagtttaaatcattactaatactcaatccttcagaatacaatctgtgtttcattgta aatttataggcggtgtatttaagttggtagattttcaattatgtatcaatatagcaacagtagttcttgctcctccttgattctagcatcctcttcattat tttcttctacgtacataaacatgtccaatacgttagacaacacaccgacgatggcggccgccacagacacgaatatgactaaaccgatgacc atttaaaaacccctctctagctttcacttaaactgtatcgattattcttttagaacatgtataatataaaaacattattctatttcgaatttaggcttcca aaaattttcatccgtaaaccgataataatatatatagacttgttaatagtcggaataaatagattaatgcttaaactatcatcatctccacgattag agatacaatatttacattttttttgctgtttcgaaactttatcaatacacgttaatacaaacccaggaaggagatattgaaactgaggctgttgaaa atgaaacggtgaatacaataattcagataatgtaaaatcatgattccgtattctgatgatattagaactgctaatggatgtcgatggtatgtatcta ggagtatctattttaacaaagcatcgatttgctaatatacaattatcattttgattaattgttattttattcatattcttaaaaggtttcatatttatcaattc ttctacattaaaaatttccatttttaatttatgtagccccgcaatactcctcattacgtttcatttttgtctataatatccattttgttcatctcggtacata gattatccaattgagaagcgcatttagtagtttttgtacattttaagtttattgacgaatcgtcgaaaactagttatagttaacattttattatttgatacc

Fig. 59 (cont'd)

ctgatattaatacccctgccgttactattatttataactgatgtaatccacgtaacattggaattaactatcgatagtaatgcatcgacgcttccaaa attgtctattataaactcaccgataatttttttattacatgttttcatattcattaggattattaaatctttaatcttactacgattgtatgcgttgatattgc aagacgtcattctaaaagacggaggatctccatcaaatgccagacaatcacgtacaaagtacatggaaataggttttgttctattgcgcatcat agatttatatagaacacccgtagaaatactaatttgttttactctataaaatactaatgcatctatttcatcgttttgtataacgtctttccaagtgtcaa attccaaatttttttcattgatagtaccaaattcttctatctctttaactacttgcatagataggtaattacagtgatgcctacatgccgttttttgaaact gaatagatgcgtctagaagcgatgctacgctagtcacaatcaccactttcatatttagaatatatatatgtaaaaatatagtagaatttcattttgttt tttttctatgctataaatgaattctcattttgcatctgctcatactccgttttatatcaataccaaagaaggaagatatctggttctaaaagccgttaaa gtatgcgatgttagaactgtagaatgcgaaggaagtaaagcttcctgcgtactcaaagtagataaaccctcatcacccgcgtgtgagagaag accttcgtcccttccagatgcgagagaatgaataacccaggaaaacaagttccgtttatgaggacggacatgctacaaaatatgttcgcgg ctaatcgcgataatgtagcttctagactttgtcctaaaatacaattatatcctttcgatattaataaatccgtgtcgtccaggttttttatctctttca gtatgtgaatagataggtattttatctctattcatcatcgaatttaagagatccgataaacattgtttgtattctccagatgtcagcatctgatacaac aatatatgtgcacataaacctctggcacttatttcatgtaccttccccttatcactaaggagaatagtatttgagaaatatgtatacatgatattatc atgaattagatatacagaatttgtaacactctcgaaatcacacgatgtgtcggcgttaagatctaatatatcactcgataacacattttcatctaga tacactagacattttttaaagctaaaatagtctttagtagtaacagtaactatgcgattattttcatcgatgatacatttcatcggcatattattacgct taccatcaaagactataccatgtgtatatctaacgtattctagcatggttgccatacgcgcattaaacttttcaggatctttggatagatcttccaat ctatctatttgagaaacacattttatcatgttcaatagttgaaacgtcggatccactatatagatattatctataaagattttaggaactacgttcatg gtatcctggcgaatattaaaactatcaatgatatgattatcgttttcatctttatcaccatatagtttctaagatatgggattttacttaatataatatta tttcccgtaataaattttattagaaatgccaaatctataagaaaagtcctcgaattagtttgaagaatatctatatcgccgtaccgtatatttggatta attagatatagagaatatgatccgtaacatatacaacttttattatggcgtctaagatattcttccatcaacttattaacattttttgactagggaagat acattatgacgtcccattacttttgccttgtctattactgcgacgttcatagaatttagcatatctcttgccaattcttccattgatgttacattataaga aattttagatgaaattacatttggagctttaatagtaagaactcctaatatgtccgtgtatgtggtcactaatacagattgtagttctataatcgtaaa taatttacctatattatatgtttgagtctgtttagaaaagtagctaagtatacgatcttttatttctgatgcagatgtatcaacatcggaaaaaaatctt tttttattctttttttactaaagatacaaatatgtctttgttaaaaacagttattttctgaatatttctagcttgtaattttaacatatgatattcgttcacacta ggtactctgcctaaataggtttctataatctttaatgtaatattaggaaaagtattctgatcaggattcctattcattttgaggatttaaaactctgatt attgtctaatatggtctcaacacaaacttttcacagagcgatagagttttgataactcgtttttcttaagaaatataaaactactgtctccagagct cgctctatcttttattttatttaattcgatacaaactcctgatactggttcagaaagtaattcattaattttcagtcctttatagaagatatttaatataga taatacaaaatcttcagttttgatatcgatctgattgatcctagaactagatatattaataacgtgctcattaggcagtttatggcagcttgataatt agatatagtatattccagttcatatttattagataccgcattgcccagattttgatattctatgaattcctctgaaaatacatccaaaataactagaca ttctattttttgtggattagtgtactctcttccctctatcatgttcactactggtgtccacgatgataaatatctagagggaatataatatagtccatag gatgccaatctagcaatgtcgaataactgtaattttattcttcgctcttcattatgaattgattcttgaggtataaacctaacacaaattatattattag acttttcgtatgtaatgtctttcatgttataagttttttaatcctggaatagaatctattttaatgaggctttaaacgcagagttctccaacgagtcaaa gcataatactctgttggttttcttatatacgatgttacgattttcttctttgaatggaataggttttgaattagtttataattacaacataatagataagg aagtgtgcaaatagtacgcggaaaaaacataatagctcccctgttttcatccatggtttaagtaaatgatcactggcttctttagtcaatggatat tcgaacattaaccgtttcatcatcattggacagaatccatatttcttaatgtaaagagtgatcaaatcattgtgtttattgtaccatcttgttgtaaatg tgtattcggttatcggatctgctccttttctattaaagtatcgatgtcgatctcgtctaagaattcaactatatcgacatatttcatttgtatacacata accattactaacgtagaatgtataggaagagatgtaacgggaacagggtttgttgattcgcaaactattctaatacataattcttctgttaatacgt cttgcacgtaatctattatagatgccaagatatctatataattattttgtaagatgatgttaactatgtgatctatataagtagtgtaataattcatgtat ttcgatatatgttccaactctgtctttgtgatgtctagtttcgtaatatctatagcatcctcaaaaaatatattcgcatatattcccaagtcttcagttct atcttctaaaaaatcttcaacgtatggaatataataatctattttacctcttctgatatcattaatgatatagttttgacactatcttctgtcaattgattc ttattcactatatctaagaaacggatagcgtccctaggacgaactactgccattaatatctctattatagcttctggacataattcatctattatacc agaattaatgggaactattccgtatctatctaacatagttttaagaaagtcagaatctaagacctgatgttcatatattggttcatacatgaaatgat

Fig. 59 (cont'd)

ctctattgatgatagtgactatttcattctctgaaaattggtaactcattctatatatgctttccttgttgatgaaggatagaatatactcaatagaattt
gtaccaacaaactgttctcttatgaatcgtatatcatcatctgaaataatcatgtaaggcatacatttaacaattagagacttgtctcctgttatcaat
atactattcttgtgataatttatgtgtgaggcaaatttgtccacgttctttaattttgttatagtagatatcaaatccaatggagctacagttcttggctt
aaacagatatagttttctggaacgaattctacaacattattataaaggactttgggtagataagtgggatgaaatcctattttaattaatgcgata
gccttgtcctcgtgcagatatccaaacgcttttgtgatagtatggcattcattgtctagaaacgctctacgaatatctgtgacagatatcatcttta
gagaatatactagtcgcgttaatagtactacaatttgtattttttaatctatctcaataaaaaaattaatatgtatgattcaatgtataactaaactact
aactgttattgataactagaatcagaatctaatgatgacgtaaccaagaagtttatctactgccaatttagctgcattattttttagcatctcgtttaga
ttttccatctgccttatcgaatactcttccgtcgatatctacacaggcataaaatgtaggagagttactaggccccactgattcaatacgaaaag
accaatctctcttagttatttggcagtactcattaataatggtgacagggttagcatctttccaatcaataatttttttagccggaataacatcatcaa
aagacttatgatcctctctcattgattttttcgcgggatacatcatctattatggcgtcagccataacatcagcatccggcttatccgcctccgttgt
cataaaccaacgaggaggaatatcgtcggagctgtacaccatagcactacgttgaagatcgtacagagctttattaacttctcgcttctccata
ttaagttgtctagttagttgtgcagcagtagctccttcgattccaatgttttaatagccgcacacacaatctctgcgtcagaacgctcgtcaatat
agatcttagacattttagagagaactaacacaaccagcaataaaactaatttattttatcatttttttattcatcatcctctggtggttcgtcgtttcta
tcgaatgtggatctgattaacccgtcatctataggtgatgctggttctggagattctggaggagatggattattatctggaagaatctctgttattt
ccttgttttcatgtatcgattgcgttgtaacattaagattgcgaaatgctctaaatttgggaggcttaaagtgttgtttgcaatctctacacgcatgtc
taactagtggaggttcgtcagcggctctagtttgaatcatcatcggcgtagtattcctacttttacagttaggacacggtgtattgtatttctcgtc
gagaacgttaaaataatcgttgtaactcacatcctttattttatctatattgtattctactcctttcttaatgcattttataccgaataagagatagcga
aggaattcttttctcggtgccgctagtaccccttaatcatatcacatagtgtttatattccaaatttgtggcaatagacggtttatttctatacgatagttt
gtttctggaatcctttgagtattctataccaatattattctttgattcgaatttagtttcttcgatattagattttgtattacctatattcttgatgtagtactt
tgatgattttttccatggcccattctattaagtcttccaagttggcatcatccacatattgtgatagtaattctcggatatcagtagcggctaccgcc
attgatgtttgttcattggatgagtaactactaatgtatacattttccatttataacacttatgtattaactttgttcatttatattttttcattattatgttgat
attaacaaaagtgaatatatatgttaataattgtattgtggttatacggctacaatttcataatgagtggaagtcagtgtccgatgatcaatgacga
tagctttactctgaaaagaaagtatcaaatcgatagtgcggagtcaacaataaaaatggataagaagaggataaagtttcagaatagagcca
aaatggtaaaagaaataaatcagacaataagagcagcacaaactcattacgagacattgaaactaggatacataaaatttaagagaatgatta
ggactactactctagaagatatagcaccatctattccaaataatcagaaaacttataaactattctcggacatttcagccatcggcaaagcatca
cagaatccgagtaagatggtatatgctctgctgctttacatgtttcccaatttgtttggagatgatcatagattcattcgttatagaatgcatccaat
gagtaaaatcaaacacaagatcttctctcctttcaaacttaatcttattagaatattagtggaagaaagattctataataatgaatgcagatctaat
aaatggagaataattggaacacaagttgataaaatgttgatagctgaatctgataaatatacaatagatgcaaggtataacctaaaacccatgt
atagaatcaagggaaaatctgaagaagataccctctttatcaaacagatggtagaacaatgtgtgacatcccaggaattggtggaaaaagtg
ttgaagatactgtttagagatttgttcaagagtggagaatacaaagcgtacagatacgatgatgatgtagaaaatggatttattggattggatac
actaaaattaaacattgttcatgatatagttgaaccatgtatgcctgttcgtaggccagtggctaagatactgtgtaaagaaatggtaaataaata
ctttgagaatccgctacatattattggtaaaaatcttcaagagtgcattgactttgttagtgaataggcatttcatctttctccaatactaattcaaatt
gttaaattaataatggatagtataaatagttattagtgataaaatagtaaaaataattattagaataagagtgtagtatcatagataactctcttctat
aaaaatggatttattcgtagaaagtatcttatatacacagtagaaaataatatagattttttaaaggatgatacattaagtaaagtaaacaatttta
ccctcaatcatgtactagctctcaagtatctagttagcaattttcctcaacacgttattactaaggatgtattagctaataccaatttttttgtttcata
catatggtacgatgttgtaaagtgtacgaagcggttttacgacacgcatttgatgcacccacgttgtacgttaaagcattgactaagaattattta
tcgtttagtaacgcaatacaatcgtacaaggaaaccgtgcataaactaacacaagatgaaaaatttttagaggttgccgaatacatggacgaa
ttaggagaacttataggcgtaaattatgacttagttcttaatccattatttcacggagggaacccatcaaagatatggaaatcatttttttaaaact
gtttaagaaaacagacttcaaagttgttaaaaaattaagtgttataagattacttatttgggcttacctaagcaagaaagatacaggcatagagtt
tgcggataatgatagacaagatatatacactctatttcaacaaactggtagaatagtccatagcaatctaacagaaacgtttagagattatatctt
tcccggagataagactagctattgggtgtggttaaacgaaagtatagctaatgatgcggatattgttcttaatagacacgccattaccatgtatg

Fig. 59 (cont'd)

ataaaattcttagttatatatactctgagataaaacaaggacgcgttaataaaaaacatgcttaagttagtttatatctttgagcctgaaaaagatatc agagaacttctgctagaaatcatatatgatattcctggagatatcctatctattattgatgcaaaaaacgacgattggaaaaaatattttattagtttt tataaagctaattttattaacggtaatacatttattagtgatagaacgtttaacgaggacttattcagagttgttgttcaaatagatcccgaatatttc gataatgaacgaattatgtctttattctctacgagtgctgcggacattaaacgatttgatgagttagatattaataacagttatatatctaatataattt atgaggtgaacgatatcacattagatacaatggatgatatgaagaagtgtcaaatctttaacgaggatacgtcgtattatgttaaggaatacaat acatacctgttttttgcacgagtcggatcccatggtcatagagaacggaatactaaagaaactgtcatctataaaatccaagagtagacggctg aacttgtttagcaaaaacattttaaaatattatttagacggacaattggctcgtctaggtcttgtgttagatgattataaaggagacttgttagttaa aatgataaaccatcttaagtctgtggaggatgtatccgcattcgttcgattttctacagataaaaaccctagtattcttccatcgctaatcaaaact attttagctagttataatatttccatcatcgtcttatttcaaaggtttttgagagataatctatatcatgtagaagaattcttggataaaagcatccatct aaccaagacggataagaaatatatacttcaattgataagacacggtagatcatagaacagaccaaatatattattaataatttgtatatacatag atataattatcacacatttttgataaatgggaactgctgcaacaattcagactcccaccaaattaatgaataaagaaaatgcagaaatgattttgg aaaaaattgttgatcatatagttatgtatattagtgacgaatcaagtgattcagaaaataatcctgaatatattgatttcgtaacagatacgaaga ctatagatctctcattataaaaagtgatcacgagtttgtaaagctatgtaaaaatcatgcagagaaaagttctccagaaacgcaacaaatgatta tcaaacacatatacgaacaatatcttattccagtatctgaagtactattaaaacctataatgtccatgggtgacataattacatataacggatgtaa agacaatgaatggatgctagaacaactctctaccctaaactttaacaatctccgcacatggaactcatgtagcataggcaatgtaacgcgtct gttttatacattttttagttatctgatgaaagataaactaaatatataagtataatcccattctaatactttaacctgatgtattacctgcatcttattaga atattaacctaactaaaagacataacatagttgataaaaagcggtaggatataaatattatggctgccaccgttccgcgttttgacgacgtgtac aaaaatgcacaaagaagaattctagatcaagaaacatttttagtagaggtcaagtagaccgttaatgaaaaacacatatctatttgataattac gcgtatggatggataccagaaactgcaatttggagtagtagatacgcaaacttagatgcaagtgactattatcccatttcgttgggattacttaa aaagttcgagtttctcatgtctctatataaaggtcctattcccgtatatgaagaaaaagtaaatactgaattcattgctaatggatcgttctctggta gatacgtatcatatcttcgaaagttttctgcccttccaacaaacgagtttattagttttttgttactgacttccattccaatctataatatcttgttctggt ttaaaaatactcagtttgatattactaaacacacattattcagatacgtctatacagataatgccaaacacctggcgttggctaggtatatgcatc aaacaggagactataagcctttgtttagtcgtctcaaagagaattatatatttaccggtcccgttccaataagtatcaaagatatagatcaccta atcttagtagagcaagaagtccatccgattatgagacattagctaatattagtactatattgtactttaccaagtatgatccggtattaatgtttttatt gttttacgtacctgggtattcaattactacaaaaattactccagccgtagaatatctaatggataaactgaatctaacaaagagcgacgtacaac tgttgtaaattattttatgcttcgtaaaatgtaggttttgaaccaaacattctttcaaagaatgagatgcataaaactttattatccaatagattgacta tttcggacgtcaatcgtttaaagtaaacttcgtaaaatattctttgatcactgccgagtttaaaacttctatcgataattgtttcatatgtttaatattta caagttttttggtccatggtacattagccggacaaatatatgcaaaataatatcgttctccaagttctatagtttctggattattttttattatattcagta accaaatacatattagggttatctgcggatttataatttgagtgatgcattcgactcaacataaataattctagaggagacgatctactatcaaatt cggatcgtaaatctgtttctaaagaacggagaatatctatacatacctgattagaattcatccgtccttcagacaacatctcagacagtctggtct tgtatgtcttaatcatattcttatgaaacttggaaacatctcttctagtttcactagtacctttattaattctctcaggtacagattttgaattcgacgat gctgagtatttcatcgttgtatatttcttcttcgattgcataatcagattcttatataccgcctcaaactctattttaaaattattaaacaatactctattat taatcagtcgttctaactctttcgctatttctatagacttatcgacatcttgactgtctatctctgtaaacacggagtcggtatctccatacacgctac gaaaacgaaatctgtaatctataggcaacgatgttttcacaatcggattaatatctctatcgtccatataaaatggattacttaatggattggcaaa ccgtaacataccgttagataactctgctccatttagtaccgattctagatacaagatcattctacgtcctatggatgtgcaactcttagccgaagc gtatgagtatagagcactatttctaaatcccatcagaccatatactgagttggctactatcttgtacgtatattgcatggaatcatagatggcctttt cagttgaactggtagcctgtttttagcatcttttttatatctggctctctctgccaaaaatgttcttaatagtctaggaatggttccttctatcgatctatc gaaaattgctatttcagagatgaggttcggtagtctaggttcacaatgaaccgtaatatatctaggaggtggatatttctgaagcaagagctgat tatttatttcttcttccaatcattggtactaacaacgacaccgactaatgtttccggagatagatttccaaagatacacacattaggatacagact gttataatcaaagattaatacattattactaaacattttttgttttggagcaaataccttaccgccttcataaggaaacttttgttttgtttctgatctaac taagatagttttagtttccaacaatagctttaacagtggacccttgatgactgtactcgctctatattcgaataccatggattgaggaagcacatat

Fig. 59 (cont'd)

gttgacgcacccgcgtctgtttttgtttctactccataatactcccacaaatactgacacaaacaagcatcatgaatacagtatctagccatatct aaagctatgtttagattataatccttatacatctgagctaaatcaacgtcatcctttccgaaagataatttatatgtatcattaggtaaagtaggaca tgatagtacgactttaaatccattttcccaaatatctttacgaattactttacatataatatcctcatcaacagtcacataattacctgtggttaaaac ctttgcaaatgcagcggctttgcctttcgcgtccgtagtatcgtcaccgatgaacgtcatttctctaactcctctatttaatactttacccatgcaac tgaacgcgttcttggatatagaatccaatttgtacgaatccaatttttcagatttttgaatgaatgaatatagatcgaaaaatatagttccattattgtt attaacgtgaaacgtagtattggccatgccgcctactcccttatgactagactgatttctctcataaatacagagatgtacagcttccttttgtcc ggagatctaaagataatcttctctcctgttaataactctagacgattagtaatatatctcagatcaaagttatgtccgttaaaggtaacgacgtagt cgaacgttagttccaacaattgtttagctattcgtaacaaaactatttcagaacatagaactagttctcgttcgtaatccatttccattagtgactgt atcctcaaacatcctctatcgacggcttcttgtatttcctgttccgttaacatctcttcattaatgagcgtaaacaataatcgtttaccacttaaatcg atataacagtaacttgtatgcgagattgggttaataaatacagaaggaaacttcttatcgaagtgacactctatatctagaaataagtacgatctt gggatatcgaatctaggtattttttagcgaaacagttacgtggatcgtcacaatgataacatccattgttaatctttgtcaaatattgctcgtccaa cgagtaacatccgtctggagatatcccgttagaaatataaaaccaactaatattgagaaattcatccatggtggcattttgtatgctgcgtttcttt ggctcttctatcaaccacatatctgcgacggagcattttctatctttaatatctagattataacttattgtctcgtcaatgtctatagttctcatctttcc caacggcctcgcattaaatggaggaggagacaatgactgatatatttcgtccgtaactacgtaataaaagtaatgaggaaatcgtataaatac ggtctcgccatttcgacatctggatttcagatataaaaatctgttttcaccgtgactttcaaaccaattaatgcaccgaacatccatttatagaattt agaaatatattttcatttaaatgaatcccaaacattggggaagagccgtatggaccattatttttatagtactttcgcaagcgggtttagacggca acatagaagcgtgtaaacgaaaactatatactatagtcagcactcttccatgtcctgcatgtagacggcacgcgactatcgctatagaggaca ataatgtcatgtctagcgatgatctgaattatatttattattttttcatcagattatttaacaatttggcatctgatcccaaatacgcgatcgatgtgac aaaggttaaccctttataaacttaacccattataaaacttatgattagtcacgactgaaataaccgcgtgattattttttggtataattctacacggc atggtttctgtaactatgaattcaaccccccgttacattagtgaaatctttaacaaacagcaaggggttcgtcaaagacataaaactcattgtttaca atcgaaatagaccccctatcacacttaaaataaaaaatatccttatcctttaccaccaaataaaattctgattggtcaatgtgaatgtattcacttaa cagttccacaaatttatttattaactccgaggcacatacatcgtcggtattttttatggcaaactttactcttccagcatccgtttctaaaaaaatatt aacgagttccatttatatcatccaatattattgaaatgacgttgatggacagatgatacaaataagaaggtacggtacctttgtccaccatctcct ccaattcatgctctattttgtcattaactttaatgtatgaaaacagtacgccacatgcttccatgacagtgtgtaacactttggatacaaaatgtttg acattagtataattgtccaagactgtcaatctataatagatagtagctataatatattctatgatggtattgaagaagatgacaatcttggcatattg atcatttaacacagacatggtatcaacagatagcttgaatgaaagagaatcagtaattggaataagcgtcttctcgatagagtgtccgtatacc aacatgtctgatattttgatgtattccattaaattatttagttttttcttttattctcgttaaacagcatttctgtcaacggaccccaacatcgttgaccg attaagttttgattgattttttccgtgtaaggcgtatctagtcagatcgtatagcctatccaataatccatcatctgtgcgtagatcacatcgtacactt tttaattctctatagaagagcgacagacagcaatttctttattctctacagatgtaagatacttgaagacattcctatgatgatgcagaattttggat aacacggtattgatggtatctgttaccataattcctttgatggctgatagtgtcagagcacaagatttccaatctttgttttgatatctatatcagaca gcatggtgcgtctgacaacacaaggattaagacggaaagatgaaatgattctctcaacatcttcaatggataccttgctatttttctggcattat ctatatgtgcgagaatatcctctagagaatcagtatccttttttgatgatagtggatctcaatgacatgggacgtctaaaccttcttattctatcacca gattgcatggtgatttgtcttctttcttttatcataatgtaatctctaaattcatcggcaaattgtctatatctaaaatcataatatgagatgtttacctct acaaatatctgttcgtccaatgttagagtatctacatcagtttgtattccaaattaaacatggcaacggatttaatttatattcctctattaagtcct cgtcgataataacagaatgtagataatcatttaatccatcgtacatggttggaagatgcttgttgacaaaatctttaattgtcttgatgaaggtggg actatatctaacatcttgattaataaaatttataacattgtccataggatactttgtaactagtttttatacacatctcttcatcggtaagtttagacaga atatcgtgaacaggtggtatattatattcatcagatatacgaagaacaatgtccaaatctatattgtttaatatattatatagatgtagcgtagctcc tacaggaatatctttaactaagtcaatgatttcatcaaccgttagatctattttaaagttaatcatataggcattgatttttaaaaggtatgtagccttg actacattctcattaattaaccattccaagtcactgtgtgtaagaagattatattctatcataagcttgactacatttggtcccgataccattaaaga attcttatgatataaggaaacagattttaggtactcatctactctacaagaatttggagagccttaacgatatcagtgacgtttattatttcaggag gaaagaatctaacattgagaatatcggaattaatagcttccagatacagtgattttggcaatagtccgtgtaatccataatccagtaacacgag

Fig. 59 (cont'd)

ctggtgcttgctagacacctttcaatgtttaatttttttgaaataagctttgataaagccttcctcgcaaattccggatacatgaacatgtcggcga
catgattaagtattgttttttcattattttctcaacaagttctcaataccccaatagatgatagaatatcacccaatgcgtccatgttgtctatttccaa
caggtcgctatatccaccaatagaagttttttccaaaaaagattctaggaacagttctaccaccagtaatttgttcaaaatagtcacgcaattcattt
tcgggtttaaattctttaatatcgacaatttcatacgctcctcttttgaaactaaacttatttagaatatccagtgcatttctacaaaaaggacatgtat
acttgacaaaaattgtcactttgttattggccaacctttgttgtacaaattcctcggccattttaatatttaagtgatataaaactatctcgacttattta
actctttagtcgagatatatggacgcagatagctatatgatagccaactacagaaggcaaacgctataaaaaacataattacgacgagcatat
ttataaatattttattcagcattacttgatatagtaatattaggcacagtcaaacattcaaccactctcgatacattaactctctcattttctttaacaa
attctacaatatcttcgtaaaaagattcttgaaactttttagaatatctatcgactctagatgaaatagcgttcgtcaacatactatgttttgtatacat
aaaggcgcccattttaacagtttctagtgacaaaatgctagcgatcctaggatcctttagaatcacatagattgacgattcgtctctcttagtaac
tctagtaaaataatcatacaatctagtacgcgaaataatattatccttgacttgaggagatctaaacaatctagttttgagaacatcgataagttca
tcgggaatgacatacatactatctttaatagaactctttcatccagttgaatggattcgtccttaaccaactgattaatgagatcttctattttatcat
tttccagatgatatgtatgtccattaaagttaaattgtgtagcgcttctttttagtctagcagccaatactttaacatcactaatatcgatatacaaag
gagatgatttatctatggtattaagaattcgttttcgacatctgtcaaaaccaattccttttgcctgtatcatccagttttccatcctttgtaaagaaa
ttattttctactagactattaataagactgataaggattcctccataattgcacaatccaaacttttaacaaaactagactttacaagatctacagg
aatgcgtaattcaggtttcttagcttgtgatttttttctttttgtggacattttcttgtgaccaactcatctaccatttcattgattttagcagtgaaataagc
tttcaatgcacgggcactgatactattgaaaacgagttgatcttcaaattccgccatttaagttcaccaaacaacttttaaatacaaatatatcaat
agtagtagaataagaactataaaaaaaataataattaaccaataccaaccccaacaaccggtattattagttgatgtgactgtttctcatcactt
agaacagatttaacaatttctataaagtctgtcaaatcatcttccggagaccccataaatacaccaaatatagcggcgtacaacttatccattat
acattgaatattggcttttctttatcgctatcttcatcatattcatcatcaatatcaacaagtcccagattacgagccagatcttcttctacattttcagt
cattgatacacgttcactatctccagagagtccgataacgttagccaccacttctctatcaatgattagtttcttgagtgcgaatgtaattttttgtttc
cgttccggatctatagaagacgataggtgtgataattgccttggccaattgtctttctctttactgagtgattctagttcaccttctatagatctgag
aatggatgattctccagtcgaaacatattctaccatggatccgtttaatttgttgatgaagatggattcatccttaaatgtttttctctgtaatagtttcc
accgaaagactatgcaaagaatttggaatgcgttccttgtgcttaatgtttccatagacggcttctagaagttgatacaacataggactagccg
cggtaactttattttttagaaagtatccatcgcttctatcttgtttagatttatttttataaagtttagtctctccttccaacataataaaagtggaagtca
tttgactagataaactatcagtaagttttatagagatagacgaacaattagcgtattgagaagcatttagtgtaacgtattcgatacattttgcatta
gatttactaatcgattttgcatactctataacacccgcacaagtctgtagagaatcgctagatgcagtaggtcttggtgaagtttcaactctcttct
tgattaccttactcatgattaaacctaaataattgtactttgtaatataatgatatatatttttcactttatctcatttgagaataaaaatgtttttgtttaac
cactgcatgatgtacagatttcggaatcgcaaaccaccagtggttttattttatccttgtccaatgtgaattgaatgggagcggatgcgggtttc
gtacgtagatagtacattcccgttttagaccgagactccatccgtaaaaatgcatactcgttagtttggaataactcggatctgctatatggatat
tcatagattgactttgatcgatgaaggctcccctgtctgcagccattttatgatcgtctttgtggaatttcccaaatagtttataaactcgcttaat
atcttctggaaggtttgtattctgaatggatccaccatctgccataatcctattcttgatctcatcattccataattttctctcggttaaaactctaagg
agatgcggattaactacttgaaattctccagacaatactctccgagtgtaaatattactggtatacggttccaccgactcattatttcccaaattt
gagcagttgatgcagtcggcataggtgccaccaataaactatttctaagaccgtatgttctgatttttatcttttagaggttcccaattccaaagatc
cgacggtacaacattccaaagatcatattgtagaataccgttactggcgtacgatcctacatatgtatcgtatggtccttccttctcagctagttc
acaactcgcctctaatgcaccgtaataaatggtttcgaagatcttcttatttagatcttgtgcttccaggctatcaaatggataatttaagagaata
aacgcgtccgctaatccttgaacaccaataccgataggtctatgtctcttattagagatttcagcttctggaataggataataattaatatctataa
ttttattgagatttctgacaattactttgaccacatccttcagtttgagaaaatcaaatcgcccatctattacaaacatgttcaaggcaacagatgc
cagattacaaacggctacctcattagcatccgcatattgtattatctcagtgcaaagattactacacttgatagttcctaaattttgttgattactcttt
ttgttacacgcatccttataaagaatgaatggagtaccagtttcaatctgagattctataatcgctttccagacgactcgagccttattatagattt
gtatctcctttctctttcgtatagtgtatacaatcgttcgaactcgtctccccaaacattgtccaatccaggacattcatccggacacatcaacgac
cactctccgtcatccttcactcgtttcataaagagatcaggaatccaaagagctataaatagatctctggttctatgttcctcgtttcctgtattcttt

Fig. 59 (cont'd)

ttaagatcgaggaacgccataatatcagaatgccacggttccaagtatatggccataactccaggccgtttgtttcctccctgatctatgtatcta gcggtgttattataaactctcaacattggaataataccgtttgatataccattggtaccggagatatagcttccactggcacgaatattactaattg atagacctattcccctgccattttagagattaatgcgcatcgtttaacgtgtcatagatacctctatgctatcatcgatcatgttaagtagaaa acagctagacatttggtgacgactagttcccgcattaaataaggtaggagaagcgtgcgtaaaccattttcagaaagtagattgtacgtctca atagctgagtctatatcccattgatgaattcctactgcgacacgcattaacatgtgctgaggtctttcaacgatcttgttgtttattttcaacaagta ggattttccaaagtttaaaaccaaaatagttgtatgaaaagtctcgttcgtaaataataaccgagttgagtttatccttatatttgttaactatatcc atggtgatacttgaaataatcggagaatgtttcccattttaggattaacatagttgaataaatcctccatcacttcactaaatagttttttgtttcctt gtgtagatttgatacggctattctggcggctagaatggcataatccggatgttgtgtagtacaagtggctgctatttcggctgccagagtgtcca attctaccgttgttactccattatatattccttgaataaccttcatagctattttaataggatctatatgatccgtgtttaagccataacataattttctaa tacgagacgtgatttttatcaaacatgacattttccttgtatccatttcgtttaatgacaaacattttgttggtgtaataaaaaaaattatttaacttttca ttaatagggatttgacgtatgtagcgtacaaaattatcgttcctggtatatagataaagagtcctatatatttgaaaatcgttacggctcgattaaa ctttaatgattgcatagtgaatatatcattaggatttaactccttgactatcatggcggcgccagaaattaccatcaaaagcattaatacagttatg ccgatcgcagttagaacggttatagcatccaccatttatatctaaaaattagatcaaagaatatgtgacaaagtcctagttgtatactgagaattg acgaaacaatgtttcttacatattttttttttttattagtaaccgacttaatagtaggaactggaaaactagacttgattattctataagtatagatacct tccaaataatattctctttgataaaagttccagaaaatgtagaattttttaaaaagttatcttttgctattaccaagattgtgtttagacgcttattattaa tatgagtgatgaaatccacaccgcctctagatatcgcttttatttccacattagatggtaaatccaatagtgaaactatcttttttaggaatgtatgga ctcgcgtttagaggagtgaacgtcttaggcgtcggaaaggatgattcatcaaacgaataaacaatttcacaaatggatgttaatgtattagtag gaaattttttgacgctagtggaattgaagattctaatggatgatgttctacctatttcatccgataacatgttaatttccgacaccaacggttttaata tttcgatgatatacggtagtctctcttcggacttatatagcttattccacaatacgagtcattatatactccaaaaaacaaaataactagtataaaa tctgtatcgaatgggaaaaacgaaattatcgacataggtatagaatctggaacattgaacgtattaatacttaattctttttctgtggtaagtaccg ataggttattgacattgtatggttttaaatattctataacttgagacttgatagatattagtgatgaattgaaaattattttttatcaccacgtgtgtttca ggatcatcgtcgacgcccgtcaaccaaccgaatggagtaaaataaatatcattaatatatgctctagatattagtattttttatcaatcctttgattat catcttctcgtaggcgaatgattccatgatcaagagtgatttaagaacatcctccggagtattaatgggcttagtaaacagtccatcgttgcaat aataaaagttatccaagttaaaggatattatgcattcgtttaaagatatcacctcatctgacggagacaattttttggtaggttttagagactttgaa gctacttgtttaacaaagttattcatcgtcgtttactattctatttaattttgtagttaatttatcacatatcacattaattgactttttggtccattttccat acgtttatattcttttaatcctgcgttatccgtttccgttatatccagggatagatcttgcaagttaaatagaatgctcttaaataatgtcattttcttatc cgctaaaaatttaaagaatgtataaaccttttcagagatttgaaactcttaggtggtgtcctagtacacaatatcataaacaaactaataaaacatt ccacattcagattccaacagctgattaacttctacattaatacagcctattttcgctccaaatgtacattcgaaaaatctgaataaaacatcgatgt cacaatttgtattatccaatacagaatgtttgtgattcgtgttaaaaccatcggagaaggaataaaaataaaaattattatagtggtggaattcagt tggaatattgcctccggagtcataaaaggatactaaacattgttttttatcataaattacacatttccaatgagacaaataacaaaatccaaacatt acaaatctagaggtagaacttttaattttgtctttaagtatatacgataagatatgtttattcataaacgcgtcaaattttttcatgaatcgctaaggag tttaagaatctcatgtcaaattgtcctatataatccacttcggatccataagcaaactgagagactaagttcttaatacttcgattgctcatccagg ctcctctctcaggctctattttcatcttgacgacctttggatttcaccagtatgtattcctttacgtgataaatcatcgattttcaaatccatttgtgag aagtctatcgccttagatacttttcccgtagtcgaggtttaaagaaatacgctaacggtatactagtaggtaactcaaagacatcatatatagaa tggtaacgcgtctttaactcgtcggttaactctttcttttgatcgagttcgtcgctactattgggtctgctcaggtgccccgactctactagttccaa catcataccgataggaatacaagacactttgccggcggttgtagatttatcatatttctccactacatatccgttacaatttgttaaaaatttagata catctatattgctacataatccagctagtgaatatatgacataataaattggtaaatcctagttctggtattttactaattactaaatctgtatatctt tccatttatcatggaaaagaatttaccagatatcttctttttttccaaactgcgttaatgtattctcttacaaatattcacaagatgaattcagtaatatg agtaaaacggaacgtgatagtttctcattggcggtgtttccagttataaaacatagatggcataacgcacacgttgtaaaacataaaggaatat acaaagttagtacagaagcacgtggaaaaaaagtatctcctccatcactaggaaaacccgcacacataaacctaaccgcgaagcaatatat atacagtgaacacacaataagctttgaatgttatagttttctaaaatgtataacaaatacagaaatcaattcgttcgatgagtatatattaagagga

Fig. 59 (cont'd)

ctattagaagctggtaatagtttacagatatttttccaattccgtaggtaaacgaacagatactataggtgtactagggaataagtatccatttagc
aaaattccattggcctcattaactcctaaagcacaacgagagatattttcagcgtggatttctcatagacctgtagtttttaactggaggaactgg
agtgggtaagacgtcacaggtacccaagttattgctttggtttaattatttatttggtggattctctactctagataaaatcactgactttcacgaaa
gaccagtcattctatctcttcctaggatagctttagttagattgcatagcaataccattttaaaatcattgggatttaaggtactagatggatctcct
atttctttacggtacggatctataccggaagaattaataaacaaacaaccaaaaaaatatggaattgtattttctacccataagttatctctaacaa
aactatttagttatggcactcttattatagacgaagttcatgagcatgatcaaataggagatattattatagcagtagcgagaaagcatcatacg
aaaatagattctatgttttttaatgactgccacgttagaggatgacagggaacggctaaaagtattttttacctaatcccgcatttatacatattcctg
gagatacactgtttaaaattagcgaggtatttattcataataagataaatccatcttccagaatggcatacatagaagaagaaaagagaaattta
gttactgctatacagatgtatactcctcctgatggatcatccggtatagtctttgtggcatccgttgcacagtgtcacgaatataaatcatatttag
aaaaaagattaccgtatgatatgtatattattcatggtaaggtcttagatatagacgaaatattagaaaaagtgtattcatcacctaatgtatcgat
aattatttctactccttatttggaatccagcgttactatacgcaatgttacacacatttatgatatgggtagagttttttgtccccgctccttttggagg
atcgcaagaatttatttctaaatctatgagagatcaacgaaaaggaagagtaggaagagttaatcctgggacatacgtatatttctatgatctgt
cttatatgaagtctatacagcgaatagattcagaatttctacataattatatattgtacgctaataagtttaatctaacactccccgaagatttgtttat
aatccctacaaatttggatattctatggcgtacaaaggaatatatagactcgttcgatattagtacagaaacatggaataaattattatccaattatt
atatgaagatgatagagtatgctaaactttatgtactaagtcctattctcgctgaggagttggataattttgagaggacgggagaattaactagta
ttgtacaagaagccattttatctctaaatttacgaattaagattttaaattttaaacataaagatgatgatacgtatatacacttttgtaaaatattattc
ggtgtctataacggaacaaacgctactatatattatcatagacctctaacgggatatatgaatatgatttcagatactatatttgttcctgtagataa
taactaaaaattttatctagtataaaaaaggcgcgccttatgtgtaatgtaatttgactcctttgagcactggctcagagtcgtcttcatcaaatttg
cagcaggatccacaagaacaacagcccttgagacaactacagcaactggtcatacagcaaagcataattgtcaccattactatggcaatca
agccagctatgaaacctagccaaatgtaccatggccatttgatatactgctcatactttccaagttcttggagatcgatgagagattcatttaaat
tcttggcaacctcattgaggcggtcaatttctttctgaatgtttacaactgaagcattaatgccagagatgtcacctaaatcaacatctggtgatgt
atgattcttgaaatatttatctaactcctccttgaatgagtctaattcaggttgcaaaggatcataaactgtgttgttgacaattcctattacaacatc
acagttaccagacacaaatgtgttgtctgtagtaatgatttgtggttcatagaaattcctttgtgttacaaaccagtgtgtgccatttgaaacaaag
acaccttcacgaggaaagtgtgctttaccatcatgacaaatggcaggagcagttgtgaagttcttctcttgtgcagggacataagtcacatgc
aagaagactacaccatgaggtgctgactgagggaaggacataagatgatagccctttccacagaaatcaactctcttagattgtccaagtac
acactctgacatcttagtagcagcaagattagcagaagctctgatttctgcagctctaattaattgttgagtcacatatgtctgcaaactttgaagt
ctgcctgtgatcaacctatcaatttgcacttcagcctcaactttgtcaagacgtgaaaggatatcatttaatacacttgaaattgcaccaaagttg
gagctaagttgtttaacaagcgtgtttaaagcttgtgcattctggttgaccacatcttgaagtttaccaagtgcacttgctgtggaagaaagtga
gtcttgaatcttgccaatagcactattaaattggttggcaatcaatttctggttctcatagagaacattctgtgtaactccaataccattaaacctat
aagccatttgcatagcaaatggtatttgtaatgcagcacctgcaccaaaggtccaaccagaagtgattgtacccgctaacagtgcagaagtgt
attgagcaatcatttcatctgtgagcaaaggtggcaatacagtaaggccgttaaacttctgtgcacaaatgaggtctctagcagcaatatcacc
aaggcaatcaccatattgtttgatgaagccagcatctgcaagtgtcactttgttgaatagtagatcttcaataaatgacctcttgcttggtttagat
ggatctggtaatatttgtgagaaattaaatccaccgaaatctttaattggtggtgtcttgtaaatttgtttgacttgtcaaatacttcttgggtgttct
tgtcttgttcaacagctattccagttaaagcacggtttaattgtgtacagaaactgccatattgcaacaatagattgctgcattcagttgaatcacc
acaaatgtacattgtacaatctactgatgtcttggtcatagacactggtagaatctctgtggtaacactaatagtaaagtttgtgggtatggcaat
agagttattagagtaagcaactgaattctctgcaccaagtgacatagtgtaggcaatgatggattgactagctacactacgtgcccgccgagg
agaattagtctgagtctgataactagcgcatatacctgcaccaatgggtatgtcacactcatatgagttgttgacatgttcagctcctattaaaca
gcctgcacgtgtttgaaatacattagaacctgtagaataaacacgccaagtaggagtaagttgatctgcatgaatagcaacagggacttctgt
gcagttaacatcctgataaagaacagcaacctggttagaagtatttgttcctggtgttataacactgacaccaccaaatgaacatggtgtaatgt
caagaatctcaagtgtctgtggatcacggacagcatcagtagtgtcagcaatgtctctgccaaattgttggaaaggcagaaacttcttgttaga
ctcagtaagaacacctgtgcctgttaaaccattgaagttgaaattgacacatttgttcttaaccaaattagtagacttcttaggtccacaaacagtt

Fig. 59 (cont'd)

gctggtgcatgtagaagttcaaatgaaagtactactactctgtatggttggtaaccaacaccattagtgggttggaaaccatatgattgtaaag
gaaagtaacaattaaatccttcaacaccattacaaggtgtgctaccggcctgatagatttcagttgaaatatctctctcgaaaggtttgagattag
acttcctaaacaatctatacaggtaattataattaccaccaaccttagaatcaagattgttagaattccaagctataacgcagcctgtaaagtcat
ctggtaatttataattataatcagcaatctttccagtttgccctggagcgatttgtctgacttcatcacctctaattacaaatgaatctgcatagacat
tagtaaagcagagatcatttaatttagtaggagacactccataacacttaaatgtggagaatgatgcggaattatataggacagaataatcagc
aacacagttgctgattctcttcctgttccaagcataaacagatgcaaatctggtggcgttaaatacttcaccgaaagggcacaagtttgtaatatt
aggaaatctaacaatagattctgttggttggactctaaagttagaagtttgatagattcctttctctacagtgaaggatttcaacgtacactttgttt
ctgagagagggtcaagtgcacagtctacagcatctgtaatggttccattctcattatatttcaataggaaagtcctaggttgaagataacccaca
taataagctgcagcaccagctgtccaacctgaagaagaatcaccaggagtcaaataacttctatgtaaagcaagtaaagtttgaaacctagtg
atgttaatacctattggcaaatctaccaatggttctaaagccgagaaaccctgagggagatcacgcactaaattaataggcgtgtgcttagaat
atatcttgaaataaccatcaatattcttaaacacaaattccctaagattcttgaaattaccctgtttaccttcaaggtccataaggaaaggctgaga
gacatattcgaaagtgcaattattcgcactagaataaactctgaactcactttccatccaactcttgttgttcttgtggtaataaacacccaagaat
ggatcattacagaattgaaattcacagactttaataacaacattagtagcgttattaacaataagtagggactgggtcttcgaatctaaagtagta
ccaaatatccagcctcttattatgttagacttctcagtggaagcgaaataaacaccatcattaaatggtaggacagggttatcaaacctcttagt
accattggtcccagagacatgtatagcatggaaccaagtaacattggagaagaaaggtaagaacaagtcctgagttgaatgtaatactgag
gatctgaatactttgtcagggtaataaacaccacgtgtgaaagaattagtgtatgcaggtggtaattgagttctggttgtaagattaacacactg
actagagactagtggcaataagacaagaaagacaaacatggtggcggcgtttatcttatttatgattatttctcgctttcaatttaacacaaccct
caagaacctttgtatttattttcaatttttataaaaatcaaactctaatgaccacatctttttttagagatgaaaaattttccacatctccttttgtagaca
cgactaaacattttgcagaaaaaagtttattagtgtttagataatcgtatacttcatcagtgtagatagtaaatgtgaacagataaaaggtattctt
gctcaatagattggtaaattccatagaatatattaatcctttcttcttgagatcccacatcatttcaaccagagacgtttatccaatgatttacctcg
tactataccacatacaaaactagattttgcagtgacgtcgtatctggtattcctaccaaacaaaattttactttagttcttttagaaaattctaaggt
agaatctctatttgccaatatgtcatctatggaattaccactagcaaaaaatgatagaaatatatattgatacatcgcagctggttttgatctactat
actttaaaaacgaatcagattccataattgcctgtatatcatcagctgaaaaactatgtttacacgtattccttcggcatttctttttaatgatatatct
tgtttagacaatgataaagttatcatgtccatgagagacgcgtctccgtatcgtataaatatttcattagatgttagacgcttcattaggggtatact
tctataaggtttcttaatcagtccatcattggttgcgtcaagaactactatcggatgttgttgggtatctctagtgttacacatggccttactaaagtt
tgggtaaataactatgatatctctattaattatagatgcatatatttcatttgtcaaggatattagtatcgacttgctatcgtcattaatacgtgtaatgt
aatcatatataaatcatgcgatagccaaggaaaatttaaatagatgttcatcatataatcgtcgctataattcatattaatacgttgacattgactaattt
gtaatatagcctcgccacgaagaaagctctcgtattcagtttcatcgataaaggataccgttaaatataactggttgccgatagtctcatagtcta
ttaagtggtaagtttcgtacaaatacagaatccctaaaatattatctaatgttggattaatctttaccataactgtataaaatggagacggagtcat
aactattttaccgtttgtacttactggaatagacgaaggaataatctccggacatgctggtaaagacccaaatgtctgtttgaagaaatccaatg
ttccaggtcctaatctcttaacaaaaattacgatattcgatcccgatatcctttgcattctatttaccagcatatcacgaactatattaagattatctat
catgtctattctcccaccgttatataaatcgcctccgctaagaaacgttagtatatccatacaatggaatacttcatttctaaaatagtattcgttttc
taattctttaatgtgaaatcgtatactagaaagggaaaaattatctttgagttttccgttagaaaagaaccacgaaactaatgttctgattgcgtcc
gattccgttgctgaattaatggatttacaccaaaaactcatataacttctagatgtagaagcattcgctaaaaaattagtagaatcaaaggatata
agtagatgttccaacaagtgagcaattcccaagatttcatctatatcattctcgaatccgaaattagaaattcccaagtagatatcctttttcatcc
gatcgttgatgaaaatacgaactttattcggtaagacaatcatttactaaggagtaaaataggaagtaatgttcgtatgtcgttatcatcgtataaa
ttaaaggtgtgttttttaccattaagtgacattataatttaccaatattggaattataatataggtgtatttgcgcactcgcgacggttgatgcatcg
gtaaatatagctgtatctaatgttctagtcggtatttcatcatttcgctgtctaataatagcgtttttctctatctgtttccattacagctgcctgaagttt
attggtcggataatatgtaaaataataagaaatacatacgaataacaaaaataaaataagatataataaagatgccatttagagatctaattttgtt
taacttgtccaaattcctacttacagaagatgaggaatcgttggagatagtgtcttccttatgtagaggatttgaaatatcttatgatgacttgataa
cttactttccagataggaaataccataaatatatttctaaagtatttgaacatgtagatttatcggaggaattaagtatggaattccatgatacaact

Fig. 59 (cont'd)

ctgagagatttagtctatcttagattgtacaagtattccaagtgtatacggccgtgttataaaattaggagataatctaaaaggcatagttgttataa
aggacaggaatatttatattagagaagcaaatgatgacttgatagaatatctcctcaaggaatacactcctcagatttatacatattctaatgagc
gcgtccccataactggttcaaaattaattctttgtggattttctcaagttacatttatggcgtatacaacgtcgcatataacaacaaataaaaaggt
agatgttctcgtttccaaaaaatgtatagatgaactagtcgatccaataaattatcaaatacttcaaaatttatttgataaaggaagcggaacaat
aaacaaaatactcaggaagatatttattcggtaaccggtggccaaactccataatttgcttttctatttcggattttagaatttccaaattcacca
gcgatttatcggttttggtgaaatccaaggatttattaatgtccacaaatgccatttgttttgtctgtggattgtatttgaaaatggaaacgatgtagt
tagatagatgcgctgcaaagtttcctattagggttccgcgctttacgtcacccagcatacttgaatcaccatcctttaaaaaaaatgataagatat
caacatggagtatatcatactcggattttaattcttctactgcatcactgacattttcacaaatactacaatacggtttaccgaaaataatcagtac
gttcttcatttatgggtatcaaaaacttaaaatcgttactgctggaaaataaatcactgacgatattagatgataatttatacaaagtatacaatgg
aatatttgtggatacaatgagtatttatatagccgtcgccaattgtgtcagaaacttagaagagttaactacggtattcataaaatacgtaaacgg
atgggtaaaaaagggagggcatgtaacccttttatcgatagaggaagtataaaaattaaacaagacgttagagacaagagacgtaaatatt
ctaaattaaccaaggacagaaaaatgctagaattagaaaagtgtacatccgaaatacaaaatgttaccggatttatggaagaagaaataaag
gcagaaatgcaattaaaaatcgatcaaactcacatttcaaatatatttatctgattctgataacataaaaatatcattgaatgagatactaacacattt
caacaataatgagaatgttacattattttattgtgatgaacgagacgcagaattcgttatgtgtctcgaggctaaaacacatttctctaccacagg
agaatggccgttgataataagtaccgatcaggatactatgctatttgcatctactgataatcatcctaagatgataaaaaaacttaactcaactgttt
aaatttgttccctcggcagaggataactatttagcaaaattaacggcgttagtgaatggatgtgatttctttcctggactctatggggcatctataa
cacccaccaacttaaacaaaatacaattgtttagtgattttacaatcgataatatagtcactagtttggcaattaaaaattattatagaaagactaa
ctctaccgtagacgtgcgtaatattgttacgtttataaacgattacgctaatttagacgatgtctactcgtatgttcctccttgtcaatgcactgttca
agaatttatattttccgcattagatgaaaaatggaacaattttaaatcatcttatttagagaccgttccgttaccctgccaattaatgtatgcattaga
accacgcaaggagattgatgtttcagaagttaaaactttatcatcttatatagatttcgaaaatactaaatcagatatcgatgttataaaatctatat
cttcgatcttcggatattctaacgaaaactgtaacactatagtgttcggcatctataaggataatttactactgagtataaatagttcattttacttta
acgatagtctgttaataaccaatactaaaagtgataatataataaatataggttactagattaaaaatggtgttccaactcgtgtgctctacgtgc
ggcaaagatatttctcacgaacgatataaattgattatacgaaaaaaatcattaaaggatgtactcgtcagtgtaaagaacgaatgttgtaggtt
aaaattatctacacaaatagaacctcaacgtaacttaacagtgcaacctctattggatataaactaatatggatccggttaattttatcaagacat
atgcgcctagaggttctattattttttattaattataccatgtcattaacaagtcatttgaatccatcgatagaaaaacatgtgggtatttattatggtac
gttattatcggaacacttggtagttgaatctacctatagaaaaggagttcgaatagtcccattggatagtttttttgaaggatatcttagtgcaaaa
gtatacatgttagagaatattcaagttatgaaaatagcagctgatacgtcattaactttattgggtattccgtatggatttggtcataatagaatgta
ttgttttaaattggtagctgaatgttataaaaatgccggtattgatacatcgtctaaacgaatattaggtaaagatatttttctgagccaaaacttca
cagatgataatagatggataaagatatatgattctaataatttaacattttggcaaattgattaccttaaagggtgagttaatatgcataactactcc
tccgttgttttttccctcgttcttttttcttaacgttgtttgccatcactctcataatgtaaagatattctaaaatggtaaactttgcatatcggacgcag
aaaattggtataaatgttgtaattgtattatttcccgtcaatggactagtcacagctccatcagtttatatcctttagagtatttctcactcgtgtctaa
cattctagagcattccatgatctgtttatcgttgatattggccggaaagatagatttttattttttattatattactattggcaattgtagatataacttct
ggtaaatattttctaccttttcaatctcttctattttcaagccggctatatattctgctatattgttgctagtatcaataccttttctggctaagaagtcat
atgtggtattcactatatcagttttaactggtagttccattagcctttccacttctgcagaataatcagaaattggttctttaccagaaaatccagcta
ctataataggctcaccgatgatcattggcaaaatcctatattgtaccagattaatgagagcatatttcatttccaataattctgctagttcttgagac
attgatttatttgatgaatctagttggttctctagatactctaccatttctgccgcatacaataacttgttagataaaatcagggttatcaaagtgttta
gcgtggctagaatagtgggcttgcatgtattaaagaatgcggtagtatgagtaaaccgttttaacgaattatatagtctccagaaatctgtggcg
ttacatacatgagccgaatgacatcgaagattgtccaatattttaatagctgctctttgtccattatttctatatttgactcgcaacaattgtagata
ccattaatcactgattccttttttcgatgccggacaatagcacaattgtttagctttggactctatgtattcagaattaatagatatatctctcaataca
gattgcactatacattttgaaactatgtcaaaaattgtagaacgacgctgttctgcagccatttaactttaaataatttacaaaaatttaaaatgagc
atccgtataaaaatcgataaactgcgccaaattgtggcatatttttcagagttcagtgaagaagtatctataaatgtagactcgacggatgagtt

Fig. 59 (cont'd)

aatgtatatttttgccgccttgggcggatctgtaaacatttgggccattatacctctcagtgcatcagtgttctaccgcggagccgaaaacattgt gtttaatcttcctgtgtccaaggtaaaatcgtgtttgtgtagttttcacaatgatgccatcatagatatagaacctgatctggaaaataatctagtaa aactttctagttatcatgtagtaagtgtcgattgtaacaaggaactgatgcctattaggacagatactactatttgtctaagtatagatcaaaagaa atcttacgtgtttaattttcacaagtatgaagaaaaatgttgtggtagaaccgtcattcatttagaatggttgttgggctttatcaagtgtattagtca gcatcagcatttggctattatgtttaaagatgacaatattattatgaagactcctggtaatactgatgcgttttccagggaatattctatgactgaat gttctcaagaactacaaaagttttctttcaaaatagctatctcgtctctcaacaaactacgaggattcaaaaagagagtcaatgtttttgaaacta gaatcgtaatggataatgacgataacattctaggaatgttgtttttcggatagagttcaatcctttaagatcaacatctttatgacgttttttagattaat actttcaatgagataaatatgggtggcagagtaagtgttgagctccctaaacgggatccgcctccgggagtacccactgatgagatgttatta aacgtggataaaatgcatgacgtgatagctcccgctaagcttttagaatatgtgcatataggaccactagcaaaagataaagaggataaagta aagaaaagatatccagagtttagattagtcaacacaggacccggtggtcttcggcattgttaagacaatcgtataatggaaccgcacccaat tgctgtcgcacttttaatcgtactcattattggaaaaaggatggaaagatatcagataagtatgaagagggtgcagtattagaatcgtgttggcc agacgttcacgacactggaaaatgcgatgttgatttattcgactggtgtcaggggggatacgttcgatagaaacatatgccatcagtggatcgg ttcagcctttaataggagtgatagaactgtagagggtcaacaatcgttaataaatctgtataataagatgcaaacattatgtagtaaagatgcta gtgtaccaatatgtgaatcatttttgcatcatttacgcgcacacaatacagaagatagcaaagagatgatcgattatattctaagacaacagtct gcggactttaaacagaaatatatgagatgtagttatcccactagagataagttagaagagtcattaaaatatgcggaacctcgagaatgttgg gatccagagtgttcgaatgccaatgttaatttcttactaacacgtaattataataatttaggactttgcaatattgtacgatgtaatactagcgtgaa caacttacagatggataaaaacttcctcattaagattgtcatgtggattaagcaatagtgatagattttctactgttcccgtcaatagagcaaaagt agttcaacataatattaaacattcgttcgacctaaaattgcatttgatcagttattatctctcttggtaatatggatactaattgtagctatttaaatgg gtgccgcggcaagcatacagacgacggtgaatacactcagcgaacgtatctcgtctaaattagaacaagaagcgaacgctagtgctcaaa caaaatgtgatatagaaatcggaaattttttatatccgacaaaaccatggatgtaacctcactgttaaaaatatgtgctctgcggacgcggatgct cagttggatgctgtgttatcagccgctacagaaacatatagtggattaacaccggaacaaaaagcatacgtaccagctatgtttactgctgcgt taaacattcagacgagtgtaaacactgttgttagagattttgaaaattatgtgaaacagacttgtaattctagcgcggtcgtcgataacaaattaa agatacaaaacgtaatcatagatgaatgttacggagccccaggatctccaacaaatttggaatttattaatacaggatctagcaaaggaaattg tgccattaaagcgttgatgcaattgacgactaaggccactactcaaatagcacctagacaagttgctggtacaggagttcagttttatatgattg ttatcggtgttataatattggcagcgttgtttatgtactatgccaagcgtatgttgttcacatccaccaatgataaaatcaaacttattttagccaata aggaaaacgtccattggactacttacatggacacattctttagaacttctccgatggttattgctaccacggatatgcaaaactgaaaatatattg ataatattttaatagattaacatggaagttatcgctgatcgtctagacgatatagtgaaacaaaatatagcggatgaaaaatttgtagattttgttat acacggtctagagcatcaatgtcctgctatacttcgaccattaattaggttgtttattgatatactattatttgttatagtaatttatatttttacggtac gtctagtaagtagaaattatcaaatgttgttggcgttggtggcgctagtcatcacattaactatttttattactttatactataatagtactagactga cttctaacaaacatctcacctgccataaataaatgcttgatattaaagtcttctatttctaacactattccatctgtggaaaataatactctgacatta tcgctaattgacacatcggtgagtgatatgcctataaagtaataatcttctttgggcacatataccagtgtaccaggttctaacaacctatttactg gtgctcctgtagcatactttttctttaccttgagaatatccatcgtttgcttggtcaatagcgatatgtgattttttatcaaccactcaaaaaagtaatt ggagtgttcatatcctctacgggctattgtctcatggccgtgtatgaaatttaagtaacacgactgtggtagatttgttctatagagccggttgcc gcaaatagatagaactaccaatatgtctgtacaaatgttaaacattaattgattaacagaaaaaacaatgttcgttctgggaatagaaaccagat caaaacaaaattcgttagaatatatgccacgtttatacatggaatataaaataactacagtttgaaaaataacagtatcatttaaacatttaacttg cggggttaatttcacaactttactgtttttaaactgttcaaaatatagcatcgatccatgagaaatacgtttagccgcctttaatagaggaaatccc accgcctttctggatctcaccaacgacgatagttctgaccagcaacttatttcttcatcatccacctgtttaacatataataggcaggagataga tatccgtcattgcaatattccttttcgtaggcacacaatctaatattgataaaatctccattctcttctctgcatttattatcttgtttcggtggctgatta ggctgtagtcttggtttaggctttggtatatcgttgttgaatctattttggtcattaaatctttcatttcttcctggtatatttctatcacctcgtttggttg gattttgtctatattatcgtttgtaacatcggtacgggtattcatttatcacaaaaaaaaacttctctaaatgagtctactgctagaaaacctcatcga agaagataccatattttttgcaggaagtatatctgagtatgatgatttacaaatggttattgccggcgcaaaatccaaatttccaagatctatgctt

Fig. 59 (cont'd)

tctatttttaatatagtacctagaacgatgtcaaaatatgagttggagttgattcataacgagaatatcacaggggcaatgtttaccacaatgtata
atataagaaacaatttgggtctaggagatgataaactaactattgaagccattgaaaactatttcttggatcctaacaatgaggttatgcctcttat
cattaataatacggatatgactgccgtcattcctaaaaaaagtggtaggagaaagaataagaacatggttattttccgtcaaggatcatcacct
atcttgtgtattttcgaaactcgtaaaaagattaatatttataaagaaaatatggaatccgcgtcgactgagtatacacctatcggagacaacaa
ggctttgatatctaaatatgcgggaattaatgtcctgaatgtgtattctccttccacatccatgagattgaatgccatttacggattcaccaataaa
aataaactagagaaacttagtactaataaggaactagaatcgtatagttctagccctcttcaagaacccattaggttaaatgattttctgggacta
ttggaatgtgttaaaaagaatattcctctaacagatattccgacaaaggattgattactataaatggagaatgttcctaatgtatactttaatcctgt
gtttatagagcccacgtttaaacattctttattaagtgtttataaacacagattaatagttttatttgaagtattcattgtattcattctaatatatgtatttt
ttagatctgaattaaatatgttcttcatgcctaaacgaaaaatacccgatcctattgatagattacgacgtgctaatctagcgtgtgaagacgata
aattaatgatctatggattaccatggatgacaactcaaacatctgcgttatcaataaatagtaaaccgatagtgtataaagattgtgcaaagctttt
gcgatcaataaatggatcacaaccagtatctcttaacgatgttcttcgcagatgatgattcattttttaagtatttggctagtcaagatgatgaatct
tcattatctgatatattgcaaatcactcaatatctagactttctgttattattattgatccaatcaaaaaataaattagaagccgtgggtcattgttatg
aatctctttcagaggaatacagacaattgacaaaattcacagactttcaagattttaaaaaactgtttaacaaggtccctattgttacagatggaa
gggtcaaacttaataaaggatatttgttcgactttgtgattagtttgatgcgattcaaaaaagaatcctctctagctaccaccgcaatagatcctat
tagatacatagatcctcgtcgcgatatcgcattttctaacgtgatggatatattaaagtcgaataaagtgaacaataattaattctttattgtcatcat
gaacggcggacatattcagttgataatcggccccatgtttttcaggtaaaagtacagaattaattagacgagttagacgttatcaaatagctcaat
ataaatgcgtgactataaaatattctaacgataatagatacggaacgggactatggacgcatgataagaataattttgaagcattggaagcaa
ctaaactatgtgatgtcttggaatcaattacagatttctccgtgataggtatcgatgaaggacagttctttccagacattgttgaattctgtgagcg
tatggcaaacgaaggaaaaatagttatagtagccgcactcgatgggacatttcaacgtaaaccgtttaataatatttttgaatcttattccattatct
gaaatggtggtaaaactaactgctgtgtgtatgaaatgctttaaggaggcttccttttctaaacgattgggtgaggaaaccgagatagagataa
taggaggtaatgatatgtatcaatcggtgtgtagaaagtgttacgtcggctcataatattatatttttttatctaaaaaactaaaaataaacattgatt
aaattttaatataatacttaaaaatggatgttgtgtcgttagataaaccgtttatgtattttgaggaaattgataatgagttagattacgaaccagaa
agtgcaaatgaggtcgcaaaaaaactgccgtatcaaggacagttaaaactattactaggagaattattttttcttagtaagttacagcgacacg
gtatattagatggtgccaccgtagtgtatataggatctgctcccggtacacatatacgttatttgagagatcatttctataatttaggagtgatcat
caaatggatgctaattgacggccgccatcatgatcctatttttaaatggattgcgtgatgtgactctagtgactcggttcgttgatgaggaatatct
acgatccatcaaaaaacaactgcatccttctaagattattttaatttctgatgtgagatccaaacgaggaggaaatgaacctagtacggcggat
ttactaagtaattacgctctacaaaatgtcatgattagtattttaaaccccgtggcgtctagtcttaaatggagatgcccgtttccagatcaatgga
tcaaggactttatatcccacacggtaataaaatgttacaacctttttgctccttcatattcagctgaaatgagattattaagtatttataccggtgag
aacatgagactgactcgagttaccaaatcagacgctgtaaattatgaaaaaaagatgtactaccttaataagatcgtccgtaacaaagtagttg
ttaactttgattatcctaatcaggaatatgactattttcacatgtactttatgctgaggaccgtgtactgcaataaaacatttcctactactaaagca
aaggtactatttctacaacaatctatatttcgtttcttaaatattccaacaacatcaactgaaaaagttagtcatgaaccaatacaacgtaaaatatc
tagcaaaaattctatgtctaaaaacagaaatagcaagagatccgtacgcagtaataaaatagaaacgtactactgagatatactaccgatatag
agtataatgatttagttactttaataaccgttagacataaaattgattctatgaaaactgtgtttcaggtatttaacgaatcatccataaattatactcc
ggttgatgatgattatggagaaccaatcattataacatcgtatcttcaaaaaggtcataacaagtttcctgtaaattttctatacatagatgtggtaa
tatctgacttatttcctagctttgttagactagatactacagaaactaatatagttaatagtgtactacaaacaggcgatggtaaaaagactcttcg
tcttcccaaaatgttagagacggaaatagttgtcaagattctctaccgtcctaatataccattaaaaattgttagattttccgcaataacatggtaa
ctggagtagagatagccgatagatctgttatttcagtcgctgattaatcaattagtagagatgagataagaacattataataatcaataatatattt
tatatcttatatcttgtttagaaaaatgctaatattaaaatagctaacgctagtaatccaatcggaagccatttgatatctataataggggtatctaattt
cctgattcagatagcggacagctatattctcggtagctactcgtttggaatcacaaacattatttacatctaatttactatctgtaatggaaacgttt
cccaatgaaatggtacaatccgatacattgcattttgttatatttttttttaaagaggctggtaacaacgcatcgcttcgtttacatggctcgtacca
acaataataggggtaatcttgtatctattcctatccgtactatgctttttatcaggataaatacatttacatcgtatatcgtctttgttagcatcacagaat

Fig. 59 (cont'd)

gcataaatttgttcgtccgtcatgataaaaatttaaagtgtaaatataactattattttatagttgtaataaaaagggaaatttgattgtatactttcgg ttctttaaaagaaactgacttgataaaaatggctgtaatctctaaggttacgtatagtctatatgatcaaaaagagattaatgctacagatattatc attagtcatgttaaaaatgacgacgatatcggtaccgttaaagatggtagactaggtgctatggatggggcattatgtaaaacttgtgggaaaa cggaattggaatgtttcggtcactggggtaaagtaagtatttataaaactcatatagttaagcctgaatttatttcagaaattattcgtttactgaatt atatatgtattcactgcggattattgcgttcacgagaaccgtattccgacgatattaacctaaaagagttatcgggacacgctcttaggagatta aaggataaaatattatccaagaaaaagtcatgttggaacagtgaatgtatgcaaccgtatcaaaaaattacttttcaaagaaaaaggtttgtttc gtcaacaagttggatgatattaacgttcctaattctctcatctatcaaaagttaatttctattcatgaaaagtttggccattattagaaattcatcaat atccagctaacttattttatacagactactttcccatccctccgttgattattagaccggctattagttttttggatagatagtatacccaaagaaacc aatgaattaacttacttattaggtatgatcgttaagaattgtaacttgaatgctgatgaacaggttatccagaaggcggtaatagaatacgatgat attaaaattatttctaataacacttccagtatcaatttatcatatatcacatccggcaaaaataatatgattagaagttatatcgtcgcccggcgaaa agatcagaccgctagatctgtaattggtcccagtacatctatcaccgttaatgaggtaggaatgcccgcatatattagaaatacacttacagaa aagatatttgttaatgcctttacagtggataaagttaaacaactattagcgtcaaaccaagttaaattttactttaataaacgattaaaccaattaac aagaatacgccaaggaaagtttatcaaaaataaaatacatttattgcctggtgattgggtagaagtagctgttcaagaatatacaagtattattttt ggaagacagccgtctctacatagatacaacgtcatcgcttcatctatcagagctaccgaaggagatactatcaaaatatctcccggaattgtc aactctcaaaatgctgatttcgacggagatgaagaatggatgatattggagcaaaatcctaaagccgtaattgaacaaagtattcttatgtatcc gacgacgttactcaaacacgatattcatggagcccccgtttatggatctattcaagatgaaatcgtagcagcgtattcattgttaggatacaag atctttgtttagatgaagtattgaacatcttggggaaatatggaagagagttcgatcctaaaggtaaatgtaaattcagcggtaaagatatctata cttacttgataggtgaaaagattaattatccgggtctcttaaaggatggtgaaattattgcaaacgacgtagatagtaattttgttgtggctatgag gcatctgtcattggctggactcttatccgatcataagtcgaacgtggaaggtatcaactttattatcaagtcatcttatgttttttaagagatatctatc tatttacggttttgggggtgacattcaaagatctgagaccaaattcgacgttcactaataaattggaggccatcaacgtagaaaaaatagaactta tcaaagaagcatacgccaaatatctcaacgatgtaagagacgggaaaatagttccattatctaaagctttagaggcggactatgtggaatcca tgttatccaacttgacaaatcttaatatccgagagatagaagaacatatgagacaaacgctgatagatgatccagataataacctcctgaaaat ggccaaagcgggttataaagtaaatcccacagaactaatgtatattctaggtacttatggacaacagaggattgatggtgaaccagcagaga ctcgagtattgggtagagtcttaccttactatcttccagactctaaggatccagaaggaagaggttacattcttaattctttaacaaaaggattaa cgggttctcaatattacttttcgatgctggttgcaagatctcaatctactgatatcgtctgtgaaacatcacgtaccggaacactggctagaaaa atcattaaaaagatggaggatatggtggtcgacggatacgacaagtagttataggtaatacgctcatcaagtacgccgccaattataccaa aattctaggctcagtatgtaaacctgtagatcttatctatccagatgagtccatgacttggtatttggaaattagtgctctgtggaataaaataaaa cagggattcgtttactctcagaaacagaaacttgcaaaaaagacattggcgccgtttaatttcctagtattcgtcaaacccaccactgaggata atgctattaaggttaaggatctgtacgatatgattcataacgtcattgatgatgtgagagagaaatacttctttacggtatctaatatagattttatg gagtatatattcttgacgcatcttaatccttctagaattagaattacaaaagaaacggctatcactatctttgaaaagttctatgaaaaactcaatta tactctaggtggtggaactcctattggaattatttctgcacaggtattgtctgagaagtttacacaacaagccctgtccagttttcacactactgaa aaaagtggtgccgtcaaacaaaaacttggtttcaacgagtttaataacttgactaatttgagtaagaataagaccgaaattatcactctggtatc cgatgatatctctaaacttcaatctgttaagattaatttcgaatttgtatgtttgggagaattaaatccaaacatcactcttcgaaaagaaacagata ggtatgtagtagatataatagtcaatagattatacatcaagagagcagaaattaccgaattagtcgtcgaatatatgattgaacgattcatctcct ttagcgtcattgtaaaggaatggggtatggaaacattcattgaggatgaggataatattagatttactgtctacctaaatttcgttgaaccggaag aattgaatcttagtaagtttatgatggttcttccggggtgccgccaacaagggcaagattagtaaattcaagattcctatctctgattatacgggat atgacgacttcaatcaaacaaaaaaagctcaataagatgactgtagaactcatgaatctaaaagaattgggttctttcgatttggaaaacgtcaa cgtgtatcctggagtatggaatacatacgatatcttcggtatcgaggccgctcgtgaatacttgtgcgaagccatgttaaacacctatggagaa gggttcgattatctgtatcagccttgtgatcttctcgctagtttactatgtgctagttacgaaccagaatcagtgaataaattcaagttcggcgcag ctagtactcttaagagagctacgttcggagacaataaagcattgttaaacgcggctcttcataaaaagtcagaacctattaacgataatagtag ctgccacttttttagcaaggtccctaatataggaactggatattacaaatactttatcgacttgggtcttctcatgagaatggaaaggaaactatct

Fig. 59 (cont'd)

gataagatatcttctcaaaagatcaaggaaatggaagaaacagaagacttttaattcttatcaataacatattttttctatgatctgtctttaaacga
tggattttccacaaatgcgcctctcaagtccctcatagaatgatacacgtataaaaaatatagcataggcaatgactccttattttttagacattag
atatgccaaaatcatagccccgcttctatttactcccgcagcacaatgaaccaacacgggctcgtttcgttgatcacatttagataaaaaaggcg
gttacgtcgtcaaaatatttactaatatcggtagttgtatcatctaccaacggtatatgaataatattaatattagagttaggtaatgtatatttatcca
tcgtcaaatttaaaacatatttgaacttaacttcagatgatggtgcatccatagcattttttataatttcccaaatacacattattggttactcttgtcatt
atagtgggagatttggctttgtgcatatctccagttgaacgtagtagtaagtatttatacaaacttttcttatccatttataacgtacaaatggataaa
actactttatcggtaaacgcgtgtaatttagaatacgttagagaaaaggctatagtaggcgtacaagcagccaaaacatcaacacttatattctt
tgttattatattggcaattagtgcgctattactctggtttcagacgtctgataatccagtctttaatgaattaacgagatatatgcgaattaaaaatac
ggttaacgattggaaatcattaacggatagcaaaacaaaattagaaagtgatagaggtagacttctagccgctggtaaggatgatatattcga
attcaaatgtgtggatttcggcgcctattttatagctatgcgattggataagaaaacatatctgccgcaagctattaggcgaggtactggagac
gcgtggatggttaaaaaggcggcaaaggtcgatccatctgctcaacaattttgtcagtatttgataaaacacaagtctaataatgttattacttgt
ggtaatgagatgttaaatgaattaggttatagcggttattttatgtcaccgcattggtgttccgattttagtaatatggaatagtgttagataaatgc
ggtaacgaatgttcctgtaaggaaccataacagcttagatttaacgttaaagatgagcataaacataataaacaaaattacaatcaaacctata
acattaatatcaaacaatccaaaaaatgaaatcagtggagtagtaaacgcgtacataactcctggataacgtttagcagctgccgttcctattct
agaccaaaaattcggtttcatgttttcgaaacggtattctgcaacaagtcgaggatcgtgttctacatatttggcggcgttatccagtatctgcct
attgatcttcatttcgttttcgattctggctatttcaaaataaaatcccgatgatagaacctccagactttataatttcatctacgatgttcagcgccgt
agtaactctaataatataggctgataagctaacatcataccctcctgtatatgtgaatatggcatgattttttgtccattacaagctcggttttaacttt
attgcctgtaataatttctctcatctgtaggatatctattttttttgtcatgcattgccttcaagacgggacgaagaaacgtaatatcctcaataacgtt
atcgttttctacaataactacatattctacctttttattttctaactcggtaaaaaaattagaatcccataggggctaaatgtctagcgatatttcttttcg
tttcctctgtacacatagtgttacaaaaccctgaaaagaagtgagtatacttgtcatcatttctaatgtttcctccagtccactgtataaacgcataa
tccttgtaatgatctggatcatccttgactaccacaacatttctttttttctggcataacttcattgtcctttacatcatcgaacttctgatcattaatatg
ctcatgaacattaggaaatgtttctgatggaggtctatcaataactggcacaacaataacaggagttttcaccgccgccatttagttattgaaatt
aatcatatacaactctttaatacgagttatattttcgtctatccattgtttcacatttacatatttcgacaaaaagatataaaatgcgtattccaatgctt
ctctgtttaatgaattactaaaatatacaaacacgtcactgtctggcaataaatgatatcttagaatattgtaacaatttattttgtattgcacatgttc
gtgatctatgagttcttcttcgaatggcataggatctccgaatctgaaaacgtataaataggagttagaataataatatttgagagtattggtaata
tataaactctttagcggtataattagttttttttctctcgatttctatttttagatgtgatggaaaaatgactaattttgtagcattagtatcatgaactcta
atcgagatcttaatatcttcgtcacacgttagttctttgaagttttaagagatgcatcagttggttcgaccgatggagtaggtgcaacaattttttg
ttcgatgtatgtatgtactggagccattgtcttaactataatggtgcttgtatcgaaaaactttaatgcagataatggaagctcttcgccgcgactt
tctacatcgtaattgggttctaacgccgatctctgaatggatactagttttctaagttctaatgtgattctctgaaaatgtaaatccaattcctccgg
cattatagatgtgtatacatcggtaaataaaactatagtatccaacgatcccttctcgcaaattctagtcttaaccaaaaaatcgtatataaccac
ggagatggcgtatttaagagtggattcttctaccgttttgttcttggatttcatataagaaactataaagtccgcactactgttaagaatgattacta
acgcaactatatagtttaaattaagcatcttggaaacataaaataactctgtagacgatacttgactttcgaataagtttgcagacaaacgaaga
aagaacagacctctcttaatttcagaagaaaactttttttcgtattcctgacgtctagagtttatatcaataagaaagttaagaattagtcggttaat
gttgtatttcattacccaagtttgagatttcataatattatcaaaagacatgataatattaaagataaagcgctgactatgaacgaaatagctatat
ggttcgctcaagaatatagtcttgttaaacgtggaaacgataactgtattttttaatcacgtcagcggcatctaaattaaatataggtatatttattcc
acacactctacaatatgccacaccatcttcataataaataaattcgttagcaaaattattaattttagtgaaatagttagcgtcaactttcatagcttc
cttcaatctaatttgatgctcacacggtgcgaattccactctaacatcccttttccatgcctcaggttcatcgatctctataatatctagtttttttgcgt
ttcacaaacacaggctcgtctctcgcgatgagatctgtatagtaactatgtaaatgataactagatagaaagatgtagctatatagatgacgatc
ctttaagagaggtatgatgactttaccccaatcagatagactgttgttatggtcttcggaaaaagaatttttataaattttccagtatttccaaatat
acgtacttaacatctaaaaaatccttaatgataataggaatggataatccgtctattttataaagaaatacatatcgcacattatactttttttttggaa
atgggaataccgatgtgtctacataaatatgcaaagtctaaatattttttagagaatcttagttggtccaaattcttttccaagtacggtaatagattt

Fig. 59 (cont'd)

ttcatattgaacggtatcttcttaatctctggttctagttccgcattaaatgatgaaactaagtcactatttttataactaacgattacatcacctctaa catcatcatttaccagaatactgatcttcttttgtcgtaaatacatgtctaatgtgttaaaaaaaagatcatacaagttatacgtcatttcatctgtggt attcttgtcattgaaggataaaactcgtactaatctcttctttaacagcctgttcaaatttatatcctatatacgaaaaaatagcaaccagtgtttgatc atccgcgtcaatattctgttctatcgtagtgtataacaatcgtatatcttcttctgtgatagtcgatacgttataaaggttgataacgaaaatattttta tttcgtgagataaagtcatcgtaggattttggacttatattcgcgtctagtagatatgcttttattttttggaatgatctcaattagaatagtctctttaga gtccatttaaagttacaaacaactaggaaattggtttatgatgtataattttttttagtttttatagattctttattctatacttaaaaaatgaaaataaaata caaaggttcttgagggttgtgttaaattgaaagcgagaaataatcataaattatttcattatcgcgatatccgttaagtttgtatcgtaatggcgtg gtcaattacaaataaagcggatactagtagcttcacaaagatggctgaaatcagagctcatctaaaaaatagcgctgaaaataaagataaaa acgaggatatttcccggaagatgtaataattccatctactaagcccaaaaccaaacgagccactactcctcgtaaaccagcggctactaaaa gatcaaccaaaaggaggaagtggaagaagaagtagttatagaggaatatcatcaaacaactgaaaaaaattctccatctcctggagtcag cgacattgtagaaagcgtggctgctgtagagctcgatgatagcgacggggatgatgaacctatggtacaagttgaagctggtaaagtaaatc atagtgctagaagcgatctttctgacctaaaggtggctaccgacaatatcgttaaagatcttaagaaaattattactagaatctctgcagtatcga cggttctagaggatgttcaagcagctggtatctctagacaatttacttctatgactaaagctattacaacactatctgatctagtcaccgaggga aaatctaaagttgttcgtaaaaaagttaaaacttgtaagaagtaaatgcgtgcacttttttataaagatggtaaactctttaccgataataattttta aatcctgtatcagacgataatccagcgtatgaggttttgcaacatgttaaaattcctactcatttaacagatgtagtagtatatgaacaaacgtgg gaggaggcgttaactagattaattttgtgggaagtgattcaaaaggacgtagacaatacttttacggaaaaatgcatgtacagaatcgcaac gctaaaagagatcgtattttttgttagagtatataacgttatgaaacgaattaattgtttataaacaaaaatataaagaaatcgtccacagattcca attatcagttggcggtttttatgttaatggaaactatgttttttattagatttggtaaaatgaaatatcttaaggagaatgaaacagtaggggttattaa cactaaaaaataaacacatagaaataagtcccgatgaaatagttatcaagttgtaggaaaggacaaagtttcacatgaatttgttgttcataag tctaatagactatataaaccgctattgaaactgacggatgattctagtcccgaagaatttctgttcaacaaactaagtgaacgaaaggtatacga atgtatcaaacagtttggtattagaatcaaggatctccgaacgtatggagtcaattatacgttttttatataattttttggacaaatgtaaagtccatat ctcctcttccgtcaccaaaaaagttaatagcgttaactatcaaacaaactgctgaagtggtaggtcatactccatcaatttcaaaaagagcttat atggcaacgactattttagaaatggtaaaggataaaaatttttttagatgtagtatctaaaactacgttcgatgaattcctatctatagtcgtagatca cgttaaatcatctacggatggatgatatagatctttacacaaataattacaagaccgataaatggaaatggataagcgtatgaaatctctcgcaa tgacagctttcttcggagagctaaacacattagatatattatggcattgataatgtctatatttaaacgccatccaaacaataccattttttcagtggat aaggatggtcagtttatgattgatttcgaatacgataattataaggcttctcaatatttggatctgaccctcactccgatatctggagatgaatgca agactcacgcatcgagtatagccgaacaattggcgtgtgtggatattattaaagaggatattagcgaatatatcaaaactactccccgtcttaa acgatttataaaaaaataccgcaatagatcagatactcgtatcagtcgagatacagaaaagcttaaaatagctctagctaaaggcatagattac gaatatataaaagacgcttgttaataagtaaatgaaaaaaaactagtcgtttataataaaacacaatatggatgccaacatagtatcatcttctac tattgcaacgtatatagacgctttagcgaagaatgcttcagaattagaacagaggtctaccgcatacgaaataaataatgaattggaactagta tttattaagccgccattaattactttgacaaatgtagtgaatatctctacgattcaggaatcgtttattcgatttaccgttactaataaggaaggtgtt aaaattagaactaagattccattatctaaggtacatggtctagatgtaaaaaatgtacagttagtagatgctatagataacatagtttgggaaaa gaaatcattagtgacggaaaatcgtcttcacaaagaatgcttgttgagactatcgacagaggaacgtcatatattttttggattacaagaaatatg gatcctctatccgactagaattagtcaatcttattcaagcaaaaacaaaaaactttacgatagactttaagctaaaatattttctaggatccggtgc ccagtctaaaagttctttattacacgctattaatcatccaaagtcaaggcctaatacatctctggaaatagaattcacacctagagacaatgaaa aagttccatatgatgaactaataaaggaattgacgactctatcacgtcatatatttatggcttctccagagaatgtaattctttctccgcctattaac gcgcctataaaaaacctttatgttgcctaaacaagatatagtaggtttggatctggaaaatctatatgccgtaactaagactgacggaattcctata actatcagagttacatcaaaagggttgtattgttattttacacatcttggttatattattagatatcctgttaagagaataatagattccgaagtagta gtctttggtgaggcagttaaggataagaactggaccgtatatctcattaagctaatagagcctgtgaatgcaatcaatgatagactagaagaa agtaagtatgttgaatctaaactagtggatatttgtgatcggatagtattcaagtcaaagaaatacgaaggtccgtttactacaactagtgaagtc gtcgatatgttatctacatatttaccaaagcaaccagaaggtgttattctgttctattcaaagggacctaaatctaacattgattttaaaattaaaaa

Fig. 59 (cont'd)

ggaaaatactatagaccaaactgcaaatgtagtatttaggtacatgtccagtgaaccaattatctttggagaatcgtctatctttgtagagtataa
gaaatttagcaacgataaaaggctttcctaaagaatatggttctggtaagattgtgttatataacggcgttaattatctaaataatatctattgtttgg
aatatattaatacacataatgaagtgggtattaagtccgtggttgtacctattaagtttatagcagaattcttagttaatggagaaatacttaaacct
agaattgataaaaccatgaaatatattaactcagaagattattatggaaatcaacataatatcatagtcgaacatttaagagatcaaagcatcaa
aataggagatatctttaacgaggataaactatcggatgtgggacatcaatacgccaataatgataaatttagattaaatccagaagttagttattt
tacgaataaacgaactagaggaccgttgggaattttatcaaactacgtcaagactcttcttatttctatgtattgttccaaaacattttagacgatt
ccaacaaacgaaaggtattggcgattgattttggaaacggtgcggacctggaaaaatacttttatggagagattgcgttattggtagcgacgg
atccggatgctgatgctatagctagaggaaatgaaagatacaacaaattaaactctggaattaaaaccaagtactacaaatttgactacattca
ggaaactattcgatccgatacatttgtctctagtgtcagagaagtattctattttggaaagtttaatatcatcgactggcagtttgctatccattattc
ttttcatccgagacattatgctaccgtcatgaataacttatccgaactaactgcttctggaggcaaggtattaatcactaccatggacggagaca
aattatcaaaattaacagataaaaagacttttataattcataagaatttacctagtagcgaaaactatatgtctgtagaaaaaatagctgatgatag
aatagtggtatataatccatcaacaatgtctactccaatgactgaatacattatcaaaaagaacgatatagtcagagtgtttaacgaatacggatt
tgttcttgtagataacgttgatttcgctacaattatagaacgaagtaaaaagtttattaatggcgcatctacaatggaagatagaccgtctacaaa
aaacttttcgaactaaatagaggagccattaaatgtgaaggtttagatgtcgaagacttacttagttactatgttgtttatgtcttttctaagcggta
aataataaatatggtatgggttctgatatccccgttctaaatgcattaaataattccaatagagcgatttttgttcctataggaccttccaactgtgga
tactctgtattgttaatagatatattaatacttttgtcgggtaacagagggttctacgtcttctaaaaataaaagtttgataacatctggcctgttcataa
ataaaaacttggcgattctatatatactcttattatcaaatctagccattgtcttatagatgtgagctactgtaggtgtaccatttgattttctttctaat
actatatatttctctcgaagaagttcttgcacatcatctgggaataaaatactactgttgagtaaatcagttatttttttttatatcgatattgatggaca
tttttatagttaaggataataagtatcccaaagtcgataacgacgataacgaagtatttatactttaggaaatcacaatgactttatcagatcaaa
attaacaaaattaaaggagcatgtatttttttctgaatatattgtgactccagatacatatggatctttatgcgtcgaattaaatgggtctagttttca
gcacggtggtagatatatagaggtggaggaatttatagatgctggaagacaagttagatggtgttctacatccaatcatatatctgaagatatg
cacactgataaatttgtcatttatgatatttatacgtttgattcgttcaagaataaacgattggtatttgtacaggtgcctccatcattaggagatgat
agctatttgactaatccgttattgtctccgtattatcgtaattcagtagccagacaaatggtcaatgatatgattttttaatcaagattcattttttaaaat
atttattagaacatctgattagaagccactatagagtttctaaacatataacaatagttagatacaaggataccgaagaattaaatctaacgaga
atatgttataatagagataagtttaaggcgtttgtattcgcttggtttaacggcgtttcggaaaatgaaaaaggtactagatacgtataaaaaaggta
tctaatttgatataatgaattcagtgactgtatcacacgcgccatatactattacttatcacgatgattgggaaccagtaatgagtcaattggtaga
gttttataacgaagtagccagttggctgctacgagacgagacgtcgcctattcctgataagttctttatacagttgaaacaaccgcttagaaata
aacgagtatgtgtgtgtggtatagatccgtatccgaaagatggaactggtgtaccgttcgaatcaccaaattttacaaaaaaatcaattaagga
gatagcttcatctatatctagattaaccggagtaattgattataaaggttataaccttaatataatagacgggggttatacctctggaattattacttaa
gttgtaaattaggagaaacaaaaagtcacgcgatctactgggataagatttccaagttactgctgcagcatataactaaacacgttagtgttctt
tattgtttgggtaaaacagatttctcgaatatacgggcaaagttagaatccccggtaactaccatagtcggatatcatccagcggctagagacc
gccaattcgagaaagatagatcatttgaaattatcaacgtttttactggaattagacaacaaggcacctataaattgggctcaagggtttatttatt
aatgctttagtgaaattttaacttgtgttctaaatggatgcaactattagaggtaatgatgttatctttgttcttaagactataggtgtcccgtcagcg
tgcagacaaaatgaagatccaagatttgtagaagcatttaaatgcgacgagttagaaagatatattgagaataatccagaatgtacactattcg
aaagtcttagggatgaggaagcatactctatagtcagaattttcatggatgtagatttagacgcgtgtctagacgaaatagattatttaacggct
attcaagattttattatcgaggtgtcaaactgtgtagctagattcgcgtttacagaatgcggtgccattcatgaaaatgtaataaaatccatgaga
tctaatttttcattgactaagtctacaaatagagataaaaacaagttttcatattatcttttttagacacgtataccactatggatacattgatagctatga
aacgaacactattagaattaagtagatcatctgaaaatccactaaccagatcgatagacactgccgtatataggagaaaaacaactcttcggg
ttgtaggtactaggaaaaatccaaattgcgacactattcatgtaatgcaaccaccgcatgataatatagaagattacctattcacttacgtggat
atgaacaacaatagttattactttctctacaacgacgattggaggatttagttcctgataagttatgggaaccagggtttatttcattcgaagacg
ctataaaaagagtttcaaaaatattcattaattctataataaactttaatgatctcgatgaaaataattttacaacggtaccactggtcatagattac

Fig. 59 (cont'd)

gtaacaccttgtgcattatgtaaaaaacgatcgcataaacatccgcatcaactatcgttggaaaatggtgctattagaatttacaaaactggtaa
tccacatagttgtaaagttaaaattgttccgttggatggtaataaactgtttaatattgcacaaagaattttagacactaactctgttttattaaccga
acgaggagaccatatagtttggattaataattcatggaaatttaacagcgaagaacccttgataacaaaactaattctgtcaataagacatcaa
ctacctaaggaatattcaagcgaattactctgtccgaggaaacgaaagactgtagaagctaacatacgagacatgttaatagattcagtggag
accgatacctatccggataaacttccgtttaaaaatggtgtattggacctggtagacggaatgttttactctggagatgatgctaaaaaatatac
gtgtactgtatcaaccggatttaaatttgacgatacaaagttcgtcgaagacagtccagaaatggaagagttaatgaatatcattaacgatatcc
aaccattaacggatgaaaataagaaaaatagagagttgtacgaaaaaactttatctagttgtttatgcggtgctaccaaaggatgtttaacattct
tttttggagaaactgcaactggaaagtcgacaaccaaacgtttgttaaagtctgctatcggtgacctgtttgttgagacgggtcaaacaatttta
acagatgtattggataaaggacctaatccatttatcgctaacatgcatttgaaaagatctgtattctgtagcgaactacctgattttgcctgtagtg
gatcaaagaaaattagatctgacaatattaaaaagttgacagaaccttgtgtcattggaagaccgtgtttctccaataaaattaataatagaaac
catgcgacaatcattatcgatactaattacaaacctgtctttgataggatagataacgcattaatgagaagaattgccgtcgtgcgattcagaac
acactttctcaaccttctggtagagaggctgctgaaaataatgacgcgtacgataaagtcaaactattagacgagggggttagatggtaaaata
caaaataatagatatagattcgcatttctatacttgttggtgaaatggtacaaaaaatatcatgttcctattatgaaactatatcctacaccggaag
agattccggactttgcattctatctcaaaataggtactctgttagtatctagctctgtaaagcatattccattaatgacggacctctccaaaaagg
gatatatattgtacgataatgtggttactcttccgttgactactttccaacagaaaatatccaagtattttaattctagactatttggacacgatatag
agagcttcatcaatagacataagaaatttgccaatgttagtgatgaatatctgcaatatatattcatagaggatatttcatctccgtaaatatatgct
catatatttatagaagatatcacatatctaaatgaataccggaatcatagatttatttgataatcatgttgatagtataccaactatattacctcatca
gttagctactctagattatctagttagaactatcatagatgagaacagaagcgtgttattgttccatattatgggatcaggtaaaacaataatcgct
ttgttgttcgccttggtagcttccagatttaaaaaggtttacattctagtgcctaatattaacattttgaaaatttttaattataaatatgggtgtagctat
gaacttgtttaatgacgaattcatagctgagaatatctttattcattccacaacaagttttattctcttaattataacgataacgtcattaattataacg
gattatctcgctacaataactctattttatcgttgatgaggcacataatatctttgggaataatactggagaacttatgaccgtgataaaaaataa
aaacaagattccttttttactattgtctggatctcccattactaacacacctaatactctgggtcatattatagatttaatgtccgaagagacgatag
attttggtgaaattattagtcgtggtaagaaagtaattcagacacttcttaacgaacgaggtgtgaatgtacttaaggatttgcttaaaggaagaa
tatcatattacgaaatgcctgataaagatctaccaacgataagatatcacggacgtaagtttctagatactagagtagtatattgtcacatgtcta
aacttcaagagagagattatatgattactagacgacagctatgttatcatgaaatgtttgataaaaatatgtataacgtgtcaatggcagtattgg
gacaacttaatctgatgaataatttagatactttatttcaggaacaggataaggaattgtacccaaatctgaaaataaataatggcgtgttatacg
gagaagaattggtaacgttaaacattagttccaaatttaaatactttattaatcggatacagacactcaacggaaaacattttatatactttctaatt
ctacatatggcggattggtaattaaatatatcatgctcagtaatggatattctgaatataatggttctcagggaactaatccacatatgataaacg
gcaaaccaaaaacatttgctatcgttactagtaaaatgaaatcgtctttagaggatctattagatgtgtataattctcctgaaaacgatgatggca
gtcaattgatgttttgtttttcgtcaaacattatgtccgaatcctatactctgaaagaggtaaggcatatttggtttatgactatcccagatacttttct
caatacaaccaaattcttggacgatctattagaaaattctcttacgccgatatttctgaaccagttaatgtatatcttttagccgccgtatattccga
tttcaatgacgaagtgacgtcattaaacgattacacacaggatgaattaattaatgtttaccatttgacatcaaaaagctgttgtatctaaaattta
agactaaagaaacgaatagaatatactctattcttcaagagatgtctgaaacgtattctcttccaccacatccatcaattgtaaaagttttattggg
agaattggtcagacaatttttttataataattctcgtattaagtataacgataccaagttacttaaaatggttacatcagttataaaaaataaagaag
acgctaggaattacatagatgatattgtaaacggtcacttctttgtatcgaataaagtatttgataaatctcttttatacaaatacgaaaacgatatt
attacagtaccgtttagactttcctacgaaccatttgtttggggagttaactttcgtaaagaatataacgtggtatcttctccataaaactgatgag
atatataaagaaataaatgtcgagctttgttaccaatggataccttccagttacattggagccacacgagctgacgttagacataaaaactaata
ttaggaatgccgtatataagacgtatctccatagagaaattagtggtaaaatggccaagaaaatagaaattcgtgaagacgtggaattacctct
cggcgaaatagttaataattctgtagttataaacgttccgtgtgtaataacctacgcgtattatcacgttggggatatagtcagaggaacattaaa
catcgaagatgaatcaaatgtaactattcaatgtggagatttaatctgtaaactaagtagagattcgggtactgtatcatttagcgattcaaagta
ctgctttttcgaaatggtaatgcgtatgacaatggcagcgaagtcactgccgttctaatggaggctcaacaaggtatcgaatctagttttgttttt

Fig. 59 (cont'd)

ctcgcgaatatcgttgactcataaaaaagagaatagcggtaagtataaacacgaatactatggcaataattgcgaatgtttattcccttcgatat
attttgataatatgaaaaacatgtctctctcaaatcggacaaccatctcataaaatagttctcgcgcgctggagaggtagttgctgctcgtataa
tctccccagaataatatacttgcgtgtcgtcgttcaatttatacggatttctatagttctctgttatataatgcggttttccatcatgattagacgacg
acaatagtgttctaaatttagatagttgatcagaatgaatgtttattggcgttggaaaaattatccatacagcgtctgcagagtggttgatagttgtt
cctagatatgtaaaataatccaacttactaggcagcaaattgtctagataaaatactgaatcaaacggtgcagacgtattggtggatctaatgg
aatccaattgattaactatctttgaaaatatacatttttatgatccgatacttgtaagaatatagaaataatgataagtccatcatcgtgttttttgcc
tcttcataagaactatattttttcttattccaatgaacaagattaatctctccagagtatttgtacacatctatcaagtgattggatccataatcgtcttc
ctttccccaatatacgtagtgatgataacacatattcattggggagaaaccctccacttatatatcctcctttaaaattaatccttactagttttcc
agtgttctggatagtggttggtttcgactcattataatgtatgtctaacggcttcaatcgcgcgttagaaattgctttttagtttctatattaatagga
gatagttgttgcggcatagtaaaaatgaaatgataactgtttaaaaatagctcttagtatgggaattacaatggatgaggaagtgatatttgaaa
ctcctagagaattaatatctattaaacgaataaaagatattccaagatcaaaagacacgcatgtgtttgctgcgtgtataacaagtgacggatat
ccgttaataggagctagaagaacttcattcgcattccaagcgatattatctcaacaaaattcagattctatctttagagtatccactaaactattac
ggtttatgtactacaatgaactaagagaaatctttagacggttgagaaaaggttctatcaacgatatcgatcctcactttgaagagttaatattatt
gggtggtaaactagataaaaaggaatctattaaagattgtttaagaagagaattaaaagaggaaagtgatgaacgtataacagtaaaagaatt
tggaaatgtaattctaaaacttacaacacgggataaaattatttaataaagtatatataagttattgcatggcgtgtttattaatcaatcgttggagg
atttatcgcatactagtatttacaatgtagaaattagaaagattaaatcattaaatgattgtattaacgacgataaatacgaatatctgtcttatattta
taatatgctagttaatagtaaatgaactttacagatctagtataattagtcagattattaagtataatagacgactagctaagtctattatttgcgag
gatgactctcaaattattacactcacggcattcgttaaccaatgcctatggtgtcataaacgagtatccgtgtccgctattttattaactactgata
acaaaatattagtatgtaacagacgagatagttttctctattctgaaataattagaactagaaacatgtctagaaagaaacgattatttctgaattat
tccaattatttgtccaaacaggaaagaagtatactatcgtcatttttttctctagatccagctactactgataatgatagaatagatgctatttatccg
ggtggcatacccaaaaggggtgagaatgttccagagtgtttatccagggaaattaaagaagaagttaatatagacaattcttttgtattcataga
cactcggtttttattcatggcatcatagaagataccattattaataaattttttgaggtaatcttctttgtcggaagaatatctttaacgagtgatcaa
atcattgatacatttaaaagtaatcatgaaatcaaggatctaatatttttagatccgaattcaggtaatggactccaatacgaaattgcaaaatatg
ctctagatactgcaaaactcaaatgttatggccatagaggatgttattacgaatcattaaaaaaattaactgaggatgattgattagaaaatataa
attaatttaccatcgtgtattttataacgggattgtccggcatatcatgtagatagttaccgtctacatcgtatactcgaccatctacgcctttaaat
cctctatttattgacattaatctattagaattggaataccaaatattagtaccctcaattagtttattggtaatattttttttagacgatagatcgatggc
tcttgaaaccaaggttttccaaccggactcattgtcgatcggtgagaagtctttttcattagcatgaatccattctaatgatgtatgtttaaacactc
taaacaattggacaaattctttgatttgctttgaatgatttcaaataggtcttcgtctacagtaggcataccattagataatctagccattataaagt
gcacgtttacatatctacgttctggaggagtaagaacgtgactattgagacgaatggctcttcctactatctgacgaagagacgcctcgttcca
tgtcatatctaaaatgaagatatcattaattgagaaaaaactaataccctcgcctccactagaagagaatacgcatgtttaatgcattctccgtta
gtgtttgattcttggttaaactcagccaccgccttgattctagtatcttttgttctagatgagaactctatattagagataccaaagactttgaaatat
agtaataagatttctattcctgactgattaacaaatggttcaaagactagacatttaccatgggatgctaatattcccaaacatacatctataaattt
gacgcttttctcttttaattcagtaaatagagagatatcagccgcactagcatcccctttcaatagttctcccttttaaaggtatctaatgcggattt
agaaaactctctatctcttaatgaatttttaaaatcattatatagtgttgctatctcttgcgcgtattcgcccggatcacgattttgtctttcaggaaag
ctatcgaacgtaaacgtagtagccatacgtctcagaattctaaatgatgatatacctgtttttatttcagcgagtttagccttttgataaatttcttctt
gcttttttcgacatattaacgtatcgcattaatactgttttcttagcgaatgatgcagacccttctacgtcatcaaaaatagaaaactcgttattaact
atgtacgaacataggcctcctagtttggagactaattcttctcatcaactagacgtttattctcaaatagcgattggtgttgtaaggatcctggtc
gtagtaagttaaccaacatggtgaattcttgcacactattaacgataggtgtagccgataaacaaatcatcttatggtttttaatgcgatggtctt
agataaaaaattatatactgaacgagtaggacggatcttaccatcttctttgattaatgatttagaaatgaagttatgacattcatcaataatgacg
catattctactcttggaattaatagttttgatattagtaaaaaatttatttctaaaattttgatcatcgtaattaataaaaatacaatccttcgttatctctg
gagcgtatctgagtatagtgttcatccaaggatcttctatcaaagcctttttcaccaataagataatagcccaattcgtataaatatccttaagatg

Fig. 59 (cont'd)

tttgagaatatatacagtagtcattgttttaccaacacccgtttcatggaacaataaaagagaatgcatactgtctaatcctaagaaaactcttgct acaaaatgttgataatccttgaggcgtactacgtctgttcccatcatttcaacaggcatattagtagttctgcgcaatgcataatcgatataggcc gcgtgtgatttactcatttatgagtgataagtaataactatgtttaaaaatcacagcagtagtttaactagtcttctctgatgtttgtttcgatactttt tgaatcagaagtcatactagaataaagcaacgagtgaacgtaatagagagcttcgtatactctattcgaaaactctaagaacttattaatgaatt ccgtatccactggattgtttaaaatactaaattgaacactgttcacatccttccaagaagaagacttagtgacggacttaacatgagacataaat aaatccaaattttttttacaaacatcactagccaccataatggcgctatctttcaaccagctatcgcttacgcattttagcagtctaacatttttaaa gagactacaatatattctcatagtatcgattacacctctaccgaataaagttggaagtttaataatacaatattttcgtttacaaaatcaaataatg gtcgaaacacgtcgaaggttaacatcttataatcgctaatgtatagattgttttcagtgagatgattattagatttaatagcatctcgttcacgtttg aacagtttattgtgtgcgctgaggtcggcaactacggcgtccgctttagtactcctcccataatactttacgctattaatctttaaaatttcatagac tttatctagatcgctttctggtaacatgatatcatgtgtaaaaagtttaacatgtcggtcggcattctatttagatcattaactctagaaatctgaag aaagtaattagctccgtattccagactaggtaatgggcttttacctaaagacaagttaagttctggcaatgtttcataaaatggaagaaggacat gcgttccctcccggatattttttacaaattcatccatttacaactctatagtttgttttcattattattagttattatctcccataatcttggtaatacttacc ccttgatcgtaagataccttatacaggtcattacatacaactaccaattgttttgtacataatagattggatggttgacatccatggtggaataaa ctactcgaacagatagtttatctttcccctagatacattggccgtaatagttgtcggcctaaagaatatctttggtgtaaagttaaaagttagggt tcttgttccattattgcttttgtcagtagttcattataaattctcgagatgggtccgttctctgaatatagaacatcatttccaaatctaacttctagtct agaaataatatcggtcttattcttaaaatctattcccttgatgaagggatcgttaatgaacaaatccttggcctttgattcggctgatctattatctcc gttatagacgttacgttgactagtccaaagacttacaggaatagatgtatcgatgatgttgatactatgtgatatgtgagcaaagattgttctctta gtggcatcactatatgttccagtaatggcggaaaacttttagaaatgttatatataaaagaatttttcgtgttccaaacattagcagattagtatg aagataaacactcatattatcaggaacattatcaatttttacatacacatcagcatcttgaatagaaacgataccatcttctggaacctcaacaat ctcggcagactccggataaccagtcggtgggccatcactaacaataactagatcatccaacaatctactcacatatgcatctatataatcttttt catcttgtgagtaccctggatacgaaataaaatttattatccgtatttccataataaggtttagtataaacagagagcgatgttgccgcatgaacttc agttacagtcgccgttggttggtttatttgacctattactctcctaggtttctctataaacgatggtttaatttgtacattcttaaccatatatccaataa agctcaattcaggaacataaacaaattctttgttgaacgtttcaaagtcgaacgaagagtcacgaataacgatatcggatactggattgaaggt taccgttacggtaattttgaatcggatagtttaagactgctgaatgtatcttccacatcaaacggagtttaatataaacgtatactgtagatggtt ctttaatagtgtcattaggagttaggccaatagaaatatcattaagttcactagaatatccagagtgtttcaaagcaattgtattattgatacaatta ttatataattcttcgccctcaatttcccaaataacaccgttacacgaagagatagatacgtgattaatacatttatatccaacatatggtacgtaac cgaatcttcccatacctttaacttctggaagttccaaactcagaaccaaatgattaagcgcagtaatatactgatccctaatttcgaagctagcg atagcctgattgtctggaccatcgtttgtcataactccggatagagaaatatattgcggcatatacaaagttggaatttgactatcgactgcgaa gacattagaccgtttaatagagtcatccccaccgatcaaagaattaatgatagtattattcattttctatttaaaatggaaaaagcttacaataaac tccgtagagaaatatctataatttgtgagttttccttaaagtaacagcttccgtaaacgccgtctttatctcttagtaggtttattgtatttatgacctttt tccttatcttcatagaatactaaaggcaacaaagaaattttttggttcttctctaagagctacgtgagacttaaccatagaagccaacgaatcccta catattttagaacagaaatacccaacttcaccacccttgaatgtctcaatactaataggtctaaaaaccaaatcttgattacaaaaccaacactta tcaattacactatttgtcttaatagacacatctgccatagatttataatactttggtagtatacaagcgagtgcttcttctttagcgggcttaaagact gctttaggtgctgaaataaccacatctggaaggcttactcgcttagccatttaattacggaactattttttatacttctaatgagcaagtagaaaa cctctcatctacaaaaacatactcgtgtccataatcctctaccatagttacacgttttttagatctcatatgtgctaaaaagttttcccatactaattg gttactattattttttcgtataattttttaacagtttgaggtttttagattttttagttacagaagtgatatcgaatatttttatccaaaaagaatgaataattaatt gtcttagaaggagtgtttttcttggcaaaagaataccaagtgcttaaatatttctactacttcattaatcttttctgtactcagattcagtttctcatctttt acttgattgattatttcaaagactaacttataatcctttttatttattctctcgttagccttaagaaaactagatacaaaatttgcatctacatcatccgt ggatatttgatttttttccatgatatccaagagttccgagataaatttctccagaacattgatgagacaataatctccgcaatacatttctcaaatgaa taagtttattagacacatggaagtttgacttttttttgtacctttgtacattttttgaaatacagactcgcaaaaaatacaatattcatatccttgttcagat actataccgttgtgtctacaaccgctacataatcgtagattcatgttaacactctacgtatctcgtcgtccaatatttttatataaaaacattttatttct

Fig. 59 (cont'd)

agacgttgccagaaaatcctgtaatattttagtttttgggctgtgaataaagtatcgccctaatatggttaccgtcctccgccaatatagtagtta aattatccgcacatgcagaagaacaccgcttaggcggattcagtacaatgttatattttcgtaccaactcatttaaatatcataatctaaaatagt tctgtaatatgtctagcgctaatatattgatcataatcctgtgcataaattaagatacaacaatgtctcgaaatcatcgacatggcttcttccatagt tagaagatcgtcgtcaaagttagcaacgtgattcatcaacatttgctgttttgaggcagcaaatactgaaccgtcgccattcaaccattcataaa aaccatcgtctgaatccattgataatttcttgtactggtttttgagagctcgcatcaatctagcatttctagctcccggattgaaaacagaaagag gatcgtacatccagggtccattttctgtaaatagaatcgtataatgtcccttcaagaagatatcagacgatccacaatcaaagaattggtctccg agtttgtaacaaactgcgggactttaacctatacatgataccgtttagcatgatttctggtgatacgtcaatcggagtatcatctattagagatctaa agccggtgtaacattctccaccaaacatattcttattctgacgtcgttctacataaaacatcattgctccattaacgataacaggggaatgaaca gcactacccatcacattagttcccaatggatcaatgtgtgtaactccagaacatcttccatatcctatgttaggaggagcgaacaccactcttcc actattgccatcgaatgccatagaataaatatccttggaattgatagaaatcggactgtcggatgttgtgatcatcttcataggattaacaactat gtatggtgccgcctgaagtttcatatcgtaactgatgccgtttataggtctagccacagaaaccaacgtaggtctaaatccaactatagacaaa atagaagccaatatctgttcttcatctgtcataacttgagagcatccagtatgaataatcttcattagatggggatctaccgcatcatcatcgttac aataaaaaattcccattctaatgttcataattgcttttctaatcatggtatgcatgtttgctctctgaatctctgtggaaattagatctgatacacctgt aatcactatcggattatcctccgtaagacgattaaccaacaacatataattataagactttacttttctaaattcataaagttgctggattaggctat aggtgtctccatgtacatacgcgttctcgagcgcaggaagtttaataccgaatagtgccatcagaataggatgaatatagtaattagtttctggt tttctataaataaaagacaaatcttgtgaactagacatatcggtaaaatgcatggattggaatcgtgtagtcgacagaagaatatgatgattaga tggagagtatattttatctaactctttgagttggtcaccgattctaggactagctcgagaatgaataagtactaaaggatgagtacatttcacaga aacactagcattgttcaatgtgctctttacatgggtaaggagttgaaatagctcgtttctatttgttctgacaatatttagtttattcataatgttaagc atatcctgaatagtaaagttagatgtgtcatacttgttagtagttagatatttagcaattgcattcccatcatttctcaatctcgtactccaatcatgc gtggatgctacttcgtcgatggaaaccatacaatccttttgataggctgttgagattgattatttcctgcacgtttaggtttggtacgttgatttcta gccccctgcggatataaagtcatcgtctacaattttggataatgaattgcatacactacaagacaaagatttatcagaagtgtgaatatgatcttca tctaccaaagaaagagtttgattagtataactagattttagtcctgcgttagatgttaaaaaaacatcgctattgaccacggcttccattatttatatt cgtagtttttactcgaaagcgtgattttaatattcaatcttattactttttggaatcgttcaaaacctttgactaattgtagaatttgatctattgccctac gcgtatactcccttgcatcatatacgttcgtcaccagatcgtttgtttcggcctgaagttggtgcatatctctttcaacattcgacatgagatcctta agggccatatcgtctagattttgttgagatgctgctcctggatttggattttgttgtgctgttgtacatactgtaccaccagtaggtgtaggagtac atacagtggccacaataggaggttgaggaggtgtaaccgttggagtagtacaagaaatacttccatccgattgttgtgtacatgtagttgttgg taacgtctgagaaggttgggtagatggcggcgtcgtcgtcttttgatctttattaaatttagagataatatcctgaacagcattgctcggcgtcaa cgctggaaggagtgaactcgccggcgcatcagtatctgcagacagccaatcaaaaagattagacatatcagatgatgtattagtttgttgtcg tggttttggtgtaggagccggtgtagctgttggaaccggctgtggagttatatgaatagttggttgtagcggttggataggctgtctgctggcg gccatcatattatctctagctagttgttctcgcaactgtctttgataatacgactcttgagactttagtcctatttcaatcgcttcatccttttttcgtatc cggatcctttctcagaataatagattgacgactttggtgtagaggattctgccagccccctgtgagaacttgttaaagaagtccatttaaggcttt aaaattgaattgcgattataagattaaatggcagacacagacgatattatcgactatgaatccgatgatctcaccgaatacgaggatgatgaa gaagaggaagaagatggagagtcactagaaactagtgatatagatcccaaatcttcttataagattgtagaatcagcatccactcatatagaa gatgcgcattccaatcttaaacatataggaatcatatatctgctcttaaacgacgctatactagacgtataagtctatttgaaatagcgggtata atagcagaaagctataacttgcttcaacgaggaagattacctctagtttcagaattttctgacgaaacgatgaagcaaaatatgctacatgtaat tatacaagagatagaggagggttcttgtcctatagtcatcgaaaagaacggagaattgttgtcggtaaacgattttgacaaagatggtctaaaa ttccatctagactatattatcaaaatttggaaacttcaaaaacgatattagaatttatacgaatatcgttctctaaatgtcacaatcaagtctcgcat gttcagcaatttattgtcgtactttatatcgtgttcattaacgatatcttgcaaaatagtaatgattctatcttccttcgatagatattcttcagagattat tgtcttatattctttcttgttatcagatatgaatttgataagactttgaacattattgatacccgtctgtttaattttttctacagatattttagttttggcag attctatcgtatctgtcaatagacatccaacatcgacattcgacgtcaattgtctataaatcaacgtataaattttagaaataacattagcgaattgt tgtgcattgatgtcgttattctgaaacagtatgattttaggtagcattttcttaacaaagagaacgtatttattgttactcagttgaacagatgatatat

Fig. 59 (cont'd)

ccagattactaacgcatctgattccatataccaaactttcagaagaaatggtgtacaattgtttgtattcattcaatgtctcttttcagaaattagttt
agagtcgaatactgcaataattttcaagagatagttttcatcagataagattttatttagtgtagatatgataaaactattgttttgttggagaacttg
atacgccgcgttctctgtagtcgacgctctcaaatgggaaacaatctccattatttttttggaatcggatacaatatcttcggtatcttgacgcaat
ctagtatacatagagttaagagaaattagagtttgtacattaagcaacatgtctctaaatgtggctgcaaacttttccttttccacatcatctagttta
ttatataccgatttcacaacggcaccagatttaaggaaccagaatgaaaaactctgataactacaatatttcatcatagttacgattttatcatcttc
tatagttggtgtaatagcgcataccttttctccaagactggaaccaacgtcataaaaatgtttaaatcaaaatccatatcaacatctgatgcgct
aagaccagtctcgcgttcaagattatctttactaatggtgacgaactcatcgtatagaactctaagtttgtccattatttatttacagatttagttgttt
aatttatttgtgctcttccagagttgggatagtattttttctaacgtcggtattatattattaggatctacgttcatatgtatcataatattaatcatccac
gttttgataaatctatctttagcttctgaaataacgtatttaaacaaaggagaaaaatatttagctacggcatcagacgcaataacattttttgtaaa
tgtaacgtatttagacgacagatcttcgttaaaaagttttccatctatgtagaatccatcggttgttaacaccattcccgcgtcagattgaatagga
gtttgaatagtttgttttggaaatagatccttcaataacttatagttgggtgggaaaaaatcgattttatcactagactctttcttttttactatcattac
ctcatgaactatttcttgaatgagtatatgtatttttctttcctatatcggacgcgttcattggaaaatataccatgtcgttaactataagaatattttat
cctcgtttacaaactgaataatatcagatgtagttcgtaaacgaactatatcatcaccagcacaacatctaactatatgatatccactagtttccttt
agtcgtttattatcttgttccatattagcagtcattccatcatttaagaaggcgtcaaagataataggagaaatgacattttggattctgttacaac
tttaccaaaattaaggatatacggacttactatctttttctcaacgtcgatttgatgaacacacgatgaaaatgtacttcgatgagattgatcatgta
gaaaacaacaagggatacaatatttccacatatcatgaaatatattaagaaatcccaccttattatatttccccaaaggatccatgcatgtaaac
attatgccgttatcattaataaagacttctttctcatcggatctgtaaaagttgttactgatttttttcattccaggatctagataattaataatgatggg
ttttctattcttattctttgtattttggcatatcctagaccagtaaacagtttccactttggtaaaatcagcagacttttgaacgctattaaacatggcat
taatggcaataactaaaaatgtaaaatattttctatgttaggaatatggtttttcactttaatagatatatggtttttggccaaaatgatagatatttttt
tatccgaggatagtaaaatattattagtcgccgtctctataaaaatgaagctagtctcgatatccaatttattctagaattgataggagtcgccaa
atgtaccttatacgttatatctcccttgatgcgttccatttgtgtatctatatcggacacaagatctgtaaatagttttacgttattaatcatcacggta
tcgccgtcgctagataacgctaatgtaccatccaagtcccaaatggagagatttaactgttcatcgtttagaataaaatgattaccggtcatatta
ataaagtgttcatcgtatctagataacaacgacttataattaatgtccaagtcttgaactcgctgaatgatcttttttaacccagttagttttagattg
gtacgaaatatattgttaaactttgattctacagtaatgtccaaatctagttgtgggaaatacttccatcaacattgtttcaaacttgataatattattat
ctacatcttcatacgatccaaattccggaatagatgtatcgcacgctctggccacccagataaccaaaaagtcacacgctccaggatatacat
tgtataaaaagctatcgttttttagtagtgtttttttctgagtatatacgaagggattaaaaatagtattatcaacgtaactatattccaaattattcttat
gagaatagataataatatcgtccttaatatctaacaaatttcctaaatatcccttttaattgagtcattcgaagcgtcaatagaatatgtctcttaacta
tttccggctgttgtatatttaaatgacttcgtaaaaaataatatatgggcgacttctcatctatgtaatcatatggagtgagatatagggctcgttct
acctcctgcccccttacccacctgtaataccaattgcggacttactatatatcgcatatttatatcgtggggtaaagtgaaaatctactaccgatga
tgtaagtcttacaatgttcgaaccagtaccagatcttaatttggaggcctccgtagaactaggggaggtaaatatagatcaaacaacaccctatg
ataaaggaaaatagcggttttatatcccgtagtagacgtctattcgcccatagatctaaggatgatgagagaaaactagcactacgattcttttt
acaaagactttattttttagatcatagagagattcattatttgttcagatgcgttgacgctgtaaaagacgtcactattaccaaaaaaaataacatta
tcgtggcgcctatatagcacttttaactatcgcatcaaaaggatgcaaacttacagaaacaatgattgaagcattctttccagaactatataatg
aacatagtaagaaatttaaattcaactctcaagtatccatcatccaagaaaaactcggataccagtttggaaactatcacgttatgattttgaac
cgtattactctacagtagctctggctattcgagatgaacattcatctggcatttttaatatccgtcaagagagttatctggtaagttcattatctgaa
ataacatatagattttatctaattaatctaaaatctgatcttgttcaatggagtgctagtacgggcgctgtaattaatcaaatggtaaatactgtattg
attacagtgtatgaaaagttacaactggtcatagaaaatgattcacaatttacatgttcattggctgtggaatcaaaacttccaataaaattactta
aagatagaaatgaattatttacaaaattcatcaacgagttaaaaaagaccagttcattcaagataagcaaacgcgataaggatacgctactaa
aatattttacttaggactggagttagaatttatagacgactcatttcgtttatcattattagtattcttcttgttatcttgttcagaaatatacagcaatgc
tatgcctaatactaaatacattatcatgcttgcaatggctctaacaacgacgaaccaaaatgaatttggtcgtagctttgttcacaaaaatacata
aagaaatgtctacataaatctatggcgccattggctacttgaaatagcgccagtcctcctacagattttaatatagctgtataacatgacatttatt

Fig. 59 (cont'd)

catcatcaaaagagacagagtcaccatctgtcatatttagatttttttcatgtgttcaaagtatcctctactcatttcattataatagtttatcatactt
agaattttaggacggatcaatgagtaagacttgactagatcgtcagtagtaatttgtgcatcgtctattctgcatccgcttcgtcgaataatgtata
gcatcgctttgagattctccatagctatcaagtctttatacaatgacatggaaatatctgtgaatactttatacttctccaacatcgatgccttaaca
tcatcgcctactttagcattgaaaatacgttctattgtgtagatggatgtagcaagatttttaaacaacaatgccattttacacgatgattgcctcaa
gtctccaatcgtttgtttagaacgattagctacagagtccaatgcttggctgactagcatattattatctttagaaattgtattcttcaatgaggcgtt
tatcatatctgtgatttcgttagtcatattacagtctgactgggttgtaatgttatccaacatatcacctatggatacggtacacgtaccagcatttgt
aataatcctatctaagatgttgtatggcattgcgcagaaaatatcttctcctgtaatatttccactctcgataaatctactcagattattcttaaatgc
cttattctctggagaaaagatatcagtgtccatcatttcattaatagtatacgcagaaaagataccacgagtatcaattctatccaagatacttatc
ggttccgagtcacagataatggtttcctctccttcgggagatcctgcatagaaatatctaggacaatagtttctatactgtctgtaactctgataat
ctctaaagtcactaactgataccatgaaattgagaagatcaaacgctgaagtaattaattttctgcctcgttttactacaactagtttcatcaat
gtagtgacgatgtattgtttagttactcttggtctaatactgatgatagagatattattacttcccataatggatcttctagtagtcaccttaaagccc
attgatgcaaatagcagatagataaagtcttggtatgactcctttctaatatagtacggactacctttgtcacccaactttatacccacataagcc
ataacaacctctttaatagccgtttcatgaggtttatcagccatgagcctgagtagttggaagaatctcatgaatcctgtctcagaaagtcctata
tgcatgatagatttatctttcctgggaaactctcgtatagtcatagatgaaatactcttcaaagtttctgaaataagattagtaacagtcttacctcc
gactactctaggtaacaaacaaactctaataggtgtttctctgcggagataatatcagaaaggatagagcaataagtagtattattgtgattata
aagaccgaatacataacaggtagaatttataaacatcatgtcctgaaggttttagacttgtattcctcgtaatccataccgtcccaaaacatgga
tttggtaactttgatagccgtagatctttgttccttcgccaacaggttaaagaaattaataaagaatttgtggtttctacctatgtctacaaattgcac
gtttggaagcgccacggttacattcactgcagcattttgaggatcgcgagtatgaagtacgatgttattgtttactggtatatctggaaagaattc
taccagtctaggaataagagattgatatcgcatagaaatacaaaagttcataatctcatcatctaagagcattttgttaccattgtaataaatatcc
actctgtcatatgtataaatgaagtactgttcaaacatgatgagatgtttatatgttggcatagtagtgagatctacgtttggtaatggcaatgtatt
aagattaactccataatgtctagcagcatctgcgatgttataagcgttgtcaaagcggggtcgatcttgtgctgttatatattgtctaacacctata
agattatcaaaatcttgtctgcttaatacaccgttaacaattttgccttgaattctttattggtgcattaataacatccttatagaggatgttaaaca
aataagtgttatcaaagttaagatctggatatttcttttctgctagaacatccattgagtcggagccatctggtttaatataaccaccgataaatcta
gctctgtattctgtatccgtcaatctaatattaagaaggtgttgagtgaaaggtggaagatcgtaaaagctgtgagtattaatgataggattagttt
ccgaactaatgttaattggggtattaataatatctatatttccagcgttaagtgtaacattaaacagtttaattcacgtgacgtggtatcaattaaat
aattaatgcccaatttggatatagcagcctgaagctcatcttgtttagttacggatcctaatgagttattaagcaatatatcgaacggatgaacga
aggttgtttaagttggtcacatactttgtaatctagacatagatgcggaagaacggtagaaactatacgaaataaatattcagagtcctctaatt
gatcaagagtaactattgacttaataggcatcatttatttagtattaaatgacgaccgtaccagtgacggatatacaaaacgatttaattacagag
ttttcagaagataattatccatctaacaaaaattatgaaataactcttcgtcaaatgtctattctaactcacgttaacaacgtggtagatagagaac
ataatgccgccgtagtgtcatctccagaggaaatatcctcacaacttaatgaagatctatttccagatgatgattctccggccactattatcgaa
cgagtacaacctcatactactattattgacgatactccacctcctacgtttcgtagagagttattgatatcggaacaacgtcaacaacgagaaa
aaagatttaatattacagtatcgaaaaatgctgaagcaataatggaatctagatctatgatatcttctatgccaacacaaacaccatccttggga
gtagtttatgataaagataaaagaattcagatgttggaggatgaagtggttaatcttagaaatcaacgatctaatacaaaatcatctgataattta
gataattttaccagaatactatttggtaagactccgtataaatcaacagaagttaataagcgtatagccatcgttaattatgcaaatttgaacggg
tctcccttatcagtcgaggacttggatgtttgttcagaggatgaaatagatagaatctataaaacgattaaacaatatcacgaaagtagaaaac
gaaaaattatcgtcactaacgtgattattattgtcataaatattatcgagcaagcattgctaaaactcggatttgaagaaatcaaaggactgagta
ccgatatcacttcagaaaattatcgatgtggagatcggagatgactgcgatgctgtagcatcaaaactaggaatcggtaacagtccggttctta
atattgtattgtttatactcaagatattcgttaaacgaattaaaattatttaatttaatacattcccatatccagacaacaatcgtctggattaatctgtt
cctgtcgtctcataccggacgacatattaatctttttattagtaggcatctttttagatggtttctttttcccagcattaactgagtcgatacctagaa
gatcgtgattgatctctccgaccattccacgaacttctaattggccgtctctgacggtaccataaactattttaccagcattagtaacagcttgga
caatctgaccatccatcgcattgtacgatgtagtagtaactgttgttctacgtctaggagcaccagaagtattttttggagcccttggatgttgatg

Fig. 59 (cont'd)

tagaagaagacgaggattttgattttggtttacatgtaatacattttgtatcacatgcgccggcagtcacatctgtttgagaattaagattattgttg
cctcctttgacggctgcatctccaccgatttgcgctagtagattttaagctgtggtgtaatcttattaactgtttcgatataatcatcgtaactgctt
ctaacggctaaatttttttatccgccatttagaagctaaaaatattttatttatgcagaagatttaactagattatacaatgaactaatatgatcctttt
tccagattatttacaaacttggtattttttggttctggaggaggcgaatttaaattcggacttggatttggattttgtgggttcttgatcttattataca
gcgcatataggatggcgacggtaactgctacgcaaataccgatcaacaaaagaataccaatcatttattgacaataacttcactattgatcaag
tatgcaatatatcatcttttcactaaataagtagtaataatgattcaacaatgtcgagatatatggacgataataatttagttcatggaaatatcgct
atgattggtatgaatgactccgctaactctgtggggcgcgcagtgctttccccacatagaataaaattagcattccgactgtgataataataccaa
gtataaacgccataatactcaatactttccatgtacgagtgggactggtagacttactaaagtcaataaaggcgaagatacacgaaagaatca
aaagaatgattccagcgattagcacgccggaaaaataatttccaatcataagcatcatatccatttaactaataaaaattttaaatcgccgaatg
aacaaagtggaatatataaaccatataaaaacaatagtttgtactgcaaaataatatctattttttgttttcgaagatatggtaaaattaaatagtagta
cacagcatgttataactaacagcagcaacggctcgtaattacttatcatttactagacgaaaaggtggtgggatattttcttgctcaaataatacg
aatatatcacccatccattttatgcgatgtttatatactctaatctttaatagatctatagacgacgggtttaccaacaatatagattttatcgattcat
ctaatttaaaccccttccttaaacgtgaatgatctcattatctggcataacgatgactctacccgatgaatcggacaatgtactgggccatgtagaat
aaattatcaacgaattatcgtctacgaacatttatatcatttgttttaattttagtacgcgaataaatagatataaaatagaaaataacagatattaca
accaatgttatggccgcgcccaaccaggtaggcagtttttatttttatcttttactacaggttctcctggatgtacgtcaccaacggcggacgtagt
tctagtacaattagacgtaagttccgcttgggaattttttaacgctaaagagttaacgttaatcgtgcacccaacgtatttacatctagttctttgaa
catcttgattataatataaccattttctatctctagattcgtcggtgcactcatgtaaccaacatacccctaggtcctaaatatttatctccggaattag
attttggataattcgcgcaccaacaatttctatttcctttatgatcgttacaaaagacgtataatgccgtatccccaaaagtaaaataatcaggac
gaataattctaataaactcagaacaatatctcgcatccatatgtttggagcaaatatcggaataagtagacatagccggtttccgttttgcacgta
accattctaaacaattgggggtttccaggatcgtttctacaaaatccagtcatgaaatcatcacaatgttctgtcttgtaattattattaaatattttgg
acagtgtttggtatttgtcttagaacaacattttgccacgctatcactatcgcccaggagataatccttttttataaaatgacatcgttgcccggat
gctatataatcagtagcgtgtttttaaatccttaatatatattcaggagttacctcgttctgataatagattaatgatccaggacgaaatttgaaagaact
acatggttctccatgaattaatacatattgtttagcaaattcaggaactataaaactactacaatgatctatcgacataccatctatcaaacaaaac
ttgggtttaatttctcccggagatgtttcataatagtacgtataactttcttctgcaaacttaacagctctattatattcaggataattaaaacctaatt
ccatatatttgtctcgtatatctgctattcctggtgctattttgattctattaagagtaacggctgcccccatttttaataatcgtcagtatttaaactgtt
aaatgttggtatatcaacatttaccttatttcccgcagtataaggtttgttgcaggtatactgttcaggaatggttacatttatacttttttctatagtcct
gtctttcgatgttcatcacatatgcaaagaacagaataaacaaaataatgtaagaaataatattaaatatctgtgaattcgtaaatacattgattgc
cataataattacagcagctacaatacatacaatagacattcccacagtgttgccattacctccacgatacatttgagttactaagcaataggtaat
aactaagctagtaagaggcaatagaaaagatgagataaatatcatcaatatagagattagaggagggctatatagagccaagacgaacaaa
atcaaaccgagtaacgttctaacatcattattttttgaagattcccaaataatcattcattcctccataatcgtttgcatcatacctccatctttaggc
ataaacgattgctgctgttcctctgtaaataaaatctttatcaagcactccagccacccgcagagaagtcgtcaagcatattgtaatatcttaaataa
ctcatttatatattaaaaaatgtcactattaaagatggagtataatctttatgccgaactaaaaaaaatgacttgtggtcaaccccctaagtctttttaa
cgaagacggggatttcgtagaagttgaaccgggatcatcctttaagtttctgatacctaagggattttacgcctctccttccgtaaagacgagtc
tagtatttgaaacattaacaacgaccgataataaaattactagtatcaatccaacaaatgcgccaaagttatatcctcttcaacgcaaagtcgtat
ctgaagtagtttctaatatgaggaaaatgatcgaatcaaaacgtcctctatacatcactcttcacttggcgtgtggatttggtaagactattacca
cgtgttatcttatggctacacacggtagaaaaaccgtcatttgcgtacccaataaaatgttaatacatcaatggaagacacaggtagaggcag
tcggattggaacataagatatccatagatggagtaagtagtctattaaaggaactaaagactcaaagtccggatgtattaatagtagtcagtag
acatctgacaaacgatgcctttttgtaaatatatcaataagcattatgatttgttcatcttggatgaatcacatacgtataatctgatgaacaatacag
cagttacaagattttagcgtattatcctccgatgatgtgttattttttaactgctacacctagaccatctaacagaatttattgtaacagtattattaat
attgccaagttatccgatctaaaaaaaactatctatgcagtagatagttttttttgagccatattccacagataatattagacatatgataaaacgatt
agatggaccatctaataaatatcatatatataccgagaagttattatctgtagacgagcctagaaatcaacttattcttaataccctggtagaaga

Fig. 59 (cont'd)

attcaagtcaggaactattaatcgcattttagttattactaaactacgtgaacatatggtattcttctacaaacgattattagattttttcggatcaga
ggttgtatttataggagacgcccaaaatagacgtactccagatatggtcaaatcaatcaaggaactaaatagatttatattcgtatccaccttattt
tattccggtactggtttagatattcctagtttggattctttgttcatttgctcggcagtaatcaacaatatgcaaatagagcaattactagggagggt
atgtcgagaaacagaactattagataggacggtatatgtatttcctagcacatccatcaaagaaataaagtacatgataggaaatttcgttcaac
gaattattagtctgtctgtagataaactaggatttaaacaaaaaagttatcggaaacatcaagaatccgatcccacttctgtatgtacaacatcct
ccagagaagaacgtgtattaaatagaatatttaactcgcaaaatcgttaagaagtttaagcgacgatccgcatgctgcgcaggccagtgtatt
acccctcatagtattaatataatccaatgatactttgtgatgtcggaaatcttaaccaatttagactgacaggcagaacacgtcatgcaatcatc
atcgtcatcgataactgtagtcttgggcttctttttgcggctcttcattccggaacgcacattggtgctatccatttaggtagtaaaaaataagtca
gaatatgccctatagcacgatcgtgcaaaacctggtatatcgtctctatctttatcacaatatagtgtatcgacatctttattattattgacctcgttt
atcttggaacatggaatgggaacattttttgttatcaacggccacctttgccttaattccagatgttgtaaaattataactaaacagtctatcatcga
cacaaatgaaattcttgtttagacgtttgtagtttacgtatgcggctcgttcgcgtctcattttttcagatattgcaggtactataatattaaaaataa
gaatgaaataacataggattaaaaataaagttatcatgacttctagcgctgatttaactaacttaaaagaattacttagtctgtacaaaagtttgaa
attttcagattctgcggctatagaaaagtataattctttggtagaatggggaacatctacttactggaaaataggcgtgcaaaaggtagctaatg
tcgagacgtcaatatctgattattatgatgaggtaaaaaataaaccgtttaatattgatccgggctattacattttcttaccggtatattttgggagc
gtctttatttattcgaagggtaaaaatatggtagaacttggatctggaaactcttttcaaataccagatgatatgcgaagtgcgtgtaacaaagta
ttagacagcgataacggaatagactttctgagatttgttttgttaaacaatagatggataatggaagatgctatatcaaaatatcagtctccagtta
atatatttaaactagctagtgagtacggattaaacatacccaaatatttagaaattgaaatagaggaagacacattatttgacgacgagttatact
ctattatagaacgctctttcgatgataaatttccaaaaaatatccatatcgtatattaagttgggagaacttaggcggcaagttgtagactttttcaaa
ttctcattcatgtatattgagtccatcaaggtagatcgtataggagataatattttattcctagcgttataacaaaatcaggaaaaaagatattagt
aaaagatgtagaccatttaatacgatccaaggttagagaacatacatttgtaaaagtaaaaaagaaaaacacattttccattttatacgactatg
atggaaacggaacagaaactagaggagaagtaataaaacgaattatagacactataggacgagactattatgttaacggaaagtatttctcta
aggttggtagtgcaggcttaaagcaattgactaataaattagatattaatgagtgcgcaactgtcgatgagttagttgatgagattaataaatcc
ggaactgtaaaacgaaaaataaaaaaccaatcagcatttgatttaagcagagaatgtttgggatatccagaagcggatttataacgttagtta
ataacatgcggttcaaaatagaaaattgtaaggttgtaaatttcaatattgaaaatactaattgtttaaataacccgagtattgagactatatatgg
aaactttaaccagttcgtctcaatctttaatatcgtcaccgatgtcaaaaaaaagattattcgagtgaaataatatgcgcctttgatataggtgcaaa
aaatcctgccagaactgttttagaagtcaaggataactccgttagggtattggatatatcaaaattagactggagttctgattgggaaaggcac
atagctaaagatttgtcacaatatgaatacactacagttcttctagaacgtcagcctagaaggtcgccgtacgtcaaatttatctattttattaaag
gctttttatatcatacatcggctgccaaagttatttgcgtctcgcctgtcatgtctggtaattcatatagagatcgaaaaaagagatcggtcgaag
catttcttgattggatggacacattcggattgcgagactccgttccggatagacgcaaattagacgatgtagcggatagtttcaatttggctatg
agatacgtattagataaatggaatactaattatacaccttataataggtgtaaatctagaaattacataaaaaaaatgtaataacgttagtaacgc
cattatggataatctatttacctttctacatgaaatagaagatagatatgccagaactatttttaactttcatctaataagttgcgatgaaataggag
atatatatggtcttatgaaagaacgcatttcctcagaggatatgtttgataatatagtgtataataaagatatacatcatgccattaagaaactagt
gtattgcgacatccaacttactaaacacattattaatcagaatacgtatccggtatttaacgattcttcacaagtgaaatgttgtcattatttcgatat
aaactcagataatagcaatattagctctcgtacagtagagatatttgagagggaaaagtcatctcttgtatcatatattaaaaactaccaataagaa
gagaaaggtcaattatggggaaataaagaaactgtacatggaggcactaatgcaaattactttccggtaaaaagtctgatgagtatctgag
cactacagtcaggtccaacattaatcaaccttggatcaaaaccatttctaagagaatgagagtagatatcattaatcactctatagtaacgcgtg
gaaaaagctctatattacaaactatagaaattattttttactaatagaacatgtgtgaaaatattcaaggattctactatgcacattattctatccaag
gacaaggatgaaaaggggtgtatacacatgattgacaaattattctatgtctattataatttatttctgttgttcgaggatatcatccaaaacgagt
actttaaagaagtagctaatgttgtaaaccacgtactcacggctacggcattagatgagaaattattcctaattaagaaaatggctgaacacga
tgtttatggagttagcaatttcaaaataggggatgtttaacctgacattttattaagtcgttggatcataccgttttcccctctctgttagatgaggatag
caaaataaagttttttaaggggaaaaagctcaatattgtagcattacgatctctggaggattgtataaattacgtgactaaatccgagaatatgat

Fig. 59 (cont'd)

agaaatgatgaaggaaagatcgactattttaaatagcatagatatagaaacggaatcggtagatcgtctaaaagaattgcttctaaaatgaaaa
aaaaacactaattcagaaatggatcaacgactcggatataagttttggtgcctgatcctaaagccggagttttttatagaccgttacatttccaa
tatgtatcgtattctaattttatattgcatcgattgcatgaaatcttgaccgtcaagcggccactcttatcgtttaagaataatacagaacgaattat
gatagaaattagcaatgttaaagtgactcctccagattactcacctataatcgcgagtattaaaggtaagagttatgacgcattagccacgttca
ctgtaaatatctttaaagaggtaatgaccaaagagggtatatccatcactaaaataagtagttatgagggaaaagattctcatttgataaaaattc
cgctactaataggatacgggaataaaaatccacttgatacagccaagtatcttgttcctaatgtcataggtggagtctttatcaataaacaatctg
tcgaaaaagtaggaattaatctagtagaaaagattacaacatggccaaaatttaggggttgttaagccaaactcattcactttctcgttttcctccgt
atcccctcctaatgtattaccgacaagatatcgccattacaagatatctctggatatatcacaattggaagcgttgaatatatcatcgacaaaga
catttataacggtcaatattgttttgctgtctcaatatttatctagagtgagtctagaattcattagacgtagtttatcatacgatatgcctccagaag
ttgtctatctagtaaacgcgataatagatagtgctaaacgaattactgaatctattactgactttaatattgatacatacattaatgacctggtggaa
gctgaacacattaaacaaaatctcagttaacgatcaacgagttcaaatatgaaatgctgcataacttttttacctcatatgaactatacacccgat
caactaaagggattttatatgatatctttactaagaaagtttctctactgtatctaccacacttctagatatccagatagagattcgatggtttgtcat
cgcatcctaacgtacggcaaatattttgagacgttggcacatgatgaattagagaattacataggcaacatccgaaacgatatcatgaacaat
cacaagaacagaggcacttacgcggtaaacattcatgtactaacaactcctggacttaatcatgcattttctagtctattgagtggaaagttcaa
aaagtcagacggtagttatcgaacacatcctcactattcatggatgcagaatatttctattcctaggagtgttggatttttatccggatcaagtaaa
gatttcaaagatgttttctgtcagaaaataccatccaagtcaatatctttacttttgttcatcggacgttccggaaagaggtcctcaggtaggttta
gtatctcaattgtctgtcttgagttccattacaaatatactaacgtctgagtatttggatttggaaaagaaaatttgtgagtatatcagatcatattat
aaagatgatataagttactttgaaacaggatttccaatcactatagaaaatgctctagtcgcatctcttaatccaaatatgatatgtgattttgtaac
tgactttagacgtagaaaacggatgggattcttcggtaacttggaggtaggtattactttagttagggatcacatgaatgaaattcgcattaatat
tggagcgggaagattagtcagaccattcttggttgtggataacggagagctcatgatggatgtgtgtccggagttagaaagcagattagacg
acatgacattctctgacattcagaaagagtttccgcatgtcatcgaaatggtagatatagaacaatttactttttagtaacgtatgtgaatcggttca
aaaatttagaatgatgtcaaaggatgaaagaaagcaatacgatttatgtgactttcctgccgaatttagagatggatatgtagcatcttcactagt
gggaatcaatcacaattctggacccagagctattcttggatgtgctcaagctaaacaagctatctcttgtctgagctcggatatacgaaataaa
atagacaatggaattcatttgatgtatccagagaggccaatcgtgattagtaaggctttagaaacttcaaagattgcggctaattgcttcggcca
acatgttactatagcattaatgtcgtacaaaggtatcaatcaagaggatggaattatcatcaaaaaacaatttattcagagaggcggtctcgata
ttgttacagccaagaaacatcaagtagaaattccgttggaaaactttaataacaaagaaagagataggtctaacgcctattcaaaattagaaag
taatggattagttagactgaatgctttcttggaatccggagacgctatagcacgaaatatctcatcaagaactcttgaagatgattttgctagaga
taatcagattagctttgatgtttccgaaaaatataccgatatgtacaaatctcgcgttgaacgagtacaagtagaacttactgacaaagttaaggt
acgagtattaaccatgaaagaaagaagacccattctaggagacaaatttaccactagaacgagtcaaaagggaacagtcgcgtatatcgcg
gatgaaacggaacttccatacgatgaaaatggtatcacaccagatgtcattattaattctacatccatcttctctagaaaaactatatctatgttga
tagaggttattttaacagccgcatattctgctaagccgtacaacaataagggagaaaaccgacctgtctgttttcctagtagtaacgaaacatc
catcgatacatatgcaattcgctaaacaatgttatgagcattcaaatccgaaattgtctgatgaagaattatcggataaaatcttttgtgaaaag
attctctatgatcctgaaacggataagccttatgcatccaaagtattttttggaccaatttattacttgcgtctgaggcatttaactcaggacaagg
caaccgttagatgtagaggtaaaaagacgaagctcattagacaggcgaatgagggacgaaaacgtggaggaggtatcaagttcggagaa
atggagagagactgtttaatagcgcatggtgcagccaatactattacagaagttttgaaagattcggaagaagattatcaagatgtgtatgtttg
tgaaaattgtggagacatagcagcacaaatcaagggtattaatacatgtcttagatgttcaaaacttaatctctctcctctcttaacaaaaattgat
accacgcacgtatctaaagtatttcttactcaaatgaacgccagaggcgtaaaagttaaattagatttcgaacgaaggcctccttcgtttttataa
accattagataaagttgatctcaaaccgtcttttctggtgtaatattctagtttggtagtagatacatatcaatatcatcaaattcgagatccgaatta
taaaatgggcgtggattgttaactatagaatcggacgtctgatattcgaaaatctgtggagtttttaggttttggtggaggtgtaactgctacttgg
gatactgaagtctgatattcagaaagctgggggggatgttctggttcgacatccaccgatggtgtcacatcactaatcggttcggtaacgtctgtg
gacgatggaggcaccacttctacaggttctggttctttatcctcagtcatcaacggagctacttcaatgcgaggaaatgtataatttggtaatgg

Fig. 59 (cont'd)

tttctcatgtggatctgaagaagaggtaagatatctactagaaagataccgatcacgttctagttctcttttgtagaacttaactttttctttctccgc
atctagttgatattccaacctcttcacgttcgcatgggttacctccgcagtttttacgagcgatttcacgttcagccttcatgcgtcttatagcatga
attcgcttatcgttatcgggtttagcttctgtcaccttagcaattccttttttattaaactctacataatcatatccatttctattgtttgttctaatataaac
gagtatagcatcattgctaaattttcaatagtatcgaaaacagaatatcctaaaccatataatatatattcaggaacactcaaactaaatgtcca
ggattctcctaaatacgtaaactttaatagtgcgaaatcattcaaaaatctaccacttatagatagatagatagtacataaatgcgtatagtagtct
acctatctctttattatgaaaaccggcattacgatcatatatgtcgtgatatacctgtgatccgtttacgttaaaccataaatacatgggtgatccta
taaacatgaatttatttctaattctcagagctatagttaattgaccgtgtaatatttgcttacatgcatacttgatacgatcattaataagatttttatcat
tgctcgttatttcagaatcgtatatataaggagtaccatcgtgattcttaccagatattatacaaaatactatatataaaatatattgacccacgtta
gtaatcatgtaaatgtttaacgttttaaattttgtattcaatgatccattatcatacgctagcatggtcttatgatattcattctttaaaatataatattgtg
ttagccattgcattggggctcctaatggagattttttattctcatccatttaggataggctttcataaagtccctaataacttcgtgaataatgtttct
atgttttctactgatgcatgtatttgcttcgatttttttatcccatgtttcatctatcatagatttaaacgcagtaatgctcgcaacattaacatcttgaa
ccgttggtacaattccgttccataaatttataatgttcgccatttatataactcattttttgaatatactttttaattaacaaaagagttaagttactcatat
ggacgccgtccagtctgaacatcaatctttttagccagagatatcatagccgctcttagagtttcagcgtgattttccaacctaaatagaacttca
tcgttgcgtttacaacacttttctatttgttcaaactttgttgttacattagtaatctttttttccaaattagttagccgttgtttgagagtttcctcattgtc
gtcttcatcggctttaacaattgcttcgcgtttagcctctggcttttttagcagccgttgtagaaaaaaattcagttgctggaattgcaagatcgtca
tctccggggaaaagagttccgtccatttaaagtacagatttagaaactgacactctgcgttatttatatttggtacaacacatggattatataat att
gatgttaataacatcagaaaatgtaaagtctatacattgttgcatcgtgttaaattttctaatggatctagtattattgggtccaacttctgcctgaaa
tccaaatatggaagcggatacaaaaccgtttcctggataaaccacacatctccacttttgctttacatcagaaattgtgtcgttgacatcttgaac
tctcctatctaatgccggtgttccacctatagattttgaatattcgaatgctgcatgagtagcattaaattccttaatattgccataattttcatatattg
agtaaccctggataaaaagtaaacacaccgcagccgtagctaccacaataaaaaaaattgatagagagttcatttataatctattagaagctg
acaaaatttttttacacgcatcagacaatgctttaataaatagttcaacatctacttttgtcatatcgaaccgatggtatgattctaacctagaattac
atccgaaaaagttgactatgttcatagtcattaagtcattaacaaacaacattccagactctggattataagacgatactgtttcgtcacaattacc
taccttaatcatgtgattatgaatattggctattagagcaccttctaagaaatctataatatctttgaaacacgatttaaaatcaaaccacgaatata
cttctacgaagaaagttagtttacccataggagaaataactataaatggagatctaaatacaaaatccggatctatgatagtttaacattattata
ttctctattaaatacctccacatctaaaaatgttaattttgaaactatgtcttcgtttattaccgtacctgaactaaacgctataagctctattgtttgag
aactctttaaacgatattcttgaaatacatgtaacaaagtttcctttaactcggtcggtttatctaccatagttacagaatttgtatccttatctataata
taataatcaaaatcgtataaagttatataattatcgcgttcagattgggatcttttcaaatagactaaaaaccccatttctctagtaagtatcttatgt
atatgtttgtaaaatatcttcatggtgggaatatgctctaccgcagttagccattcctcattgacagcggtagatgtattagacaaaactattccaa
tgtttaacaagggccattttacgagattattaaatccttgtttgataaatgtagccaatgagggttcgagttcaacgacgattgaattctcttcccg
cggatgctgcatgatgaacgacgggatgttgttcgattgatttggaattcttttcgactttttgtttatattaaatattttaaaatttatagcggatag
caattcatgtaccacggataatgtagacgcgtattgcgcatcgatatctttattattagataaaatttatcaataaatgtgagaagtttgcctcgttaa
ggtcttccatttaaatattatataaacatttgtgtttgtatcttattcgtcttttatggaatagttttttactagtaaagctgcaattacacactttgtccgt
aaaacataaatataaacaccagctttatcaatcgttccaaaaagtcgacggcggacattttaacatggcatctattttaaatacacttaggttttt
ggaaaaaacatcattttataattgtaacgattcaataactaaagaaaagattaagattaaacataagggaatgtcatttgtattttataagccaaa
gcattctaccgttgttaaatacttgtctggaggaggtatatatcatgatgatttggttgtattggggaaggtaacaattaatgatctaaagatgatg
ctattttacatggatttatcatatcatggagtgacaagtagtggaacaatttacaaattgggatcgtctatcgatagactttctctaaataggactat
tgttacaaaagttaataattataattatgatacatttttttgacgatgatgattgatcgctattgcacaattttgtttttttactttctaatatagcgtttagat
tcttttttcatgtgcgaatattgatttactaaaatatctatgtttaacttttgttctataacgtccttatcggcggtatcggtacatatacgtaattcacctt
cacaaaatacggagtcttcgataataaatagccaatcgattattggatctagctgtctgtatcatattcaacatgtttaatatatccttcgtttcccctt
tacaggcatcgatcgtagcatattttccgcgtctgagatggaaatgttaaaactacaaaaatgcgtaatgttagcccgtcctaatattggtacgt
gtctataagtttggcatagtagaataatagacgtgtttaaatgccttccaaagtttaagaattctattagagtattgcattttgatagtttatcgccta

Fig. 59 (cont'd)

catcatcaaaaataagtaaaaagtgtgctgatttttatgattttgtgcgacagcaatacattttctatgttacttttagttcgtatcagattatattcta gagattcctgactactaacgaaattaatatgatttggccaaatgtatccatcataatctggattataaacgggtgtaaacaagaatacatgtttata tttttaactagtgtagaaaacagagatagtaaatagatagttttccagatccagatcctcccgttaaaaccattctaaacggcatttttaataaat tttctcttgaaaattgtttttcttggaaacaattcataattatatttacagttactaaattaatttgataataaatcaaaatatggaaaactaaggtcgtt agtagggaggagaacaaagaaggcacatcgtgacataaataacatttattatcatgatgacaccagaaaacgacgaagagcagacatctgt gttctccgctactgtttacagagacaaaattcagggaaagaataaacgcaaacgcgtgattggtctatgtattagaatatctatggttatttcact actatctatgattaccatgtccgcgtttctcatagtgcgcctaaatcaatgcatgtctgctaacgaggctgctattactgacgccgctgttgccgt tgctgctgcatcatctactcatagaaaggttgcgtctagcactacgcaatatgatcacaaagaaagctgtaatggtttatattaccagggttcttg ttatatattacattcagactaccagttattctcggatgctaaagcaaattgcactgcggaatcatcaacactacccaataaatccgatgtcttgact acctggctcattgattatgttaaggatacatggggatctgatggtaatccaattacaaaaactacatccgattatcaagattctgatgtatcacaa gaagttagaaagtatttttgtgttaaaacaatgaactaatatttatttttgtacattaataaatgaaatcgcttaatagacaaactgtaagtaggttta agaagttgtcggtgccggtcgctataatgatgatactctcaaccattattagtggcataggaacatttctgcattacaaagaagaactgatgcct agtgcttgcgccaatggatgggatacaatacgataaacattgttatttagatactaacattaaaatgtctacagataatgcggtttatcagtgtcgta aattacgagccagattgcctagaccggatactagacatctgagagtattgtttagtattttttataaagattattgggtaagtttaaaaaagaccaa tgataaatggttagatattaataatgataaagatatagatattagtaaattaacaaattttaaacaactaaacagtacgacggatgctgaagcgtg ttatatatacaagtctggaaaactggttaaaacagtatgtaaaagtactcaatctgtactatgtgttaaaaaattctacaagtgacaacaaaaaat gaattaataataagtcgttaacgtacgccgccatggacgccgcgtttgttattactccaatgggtgtgttgactataacagatacattgtatgatg atctcgatatctcaatcatggactttataggaccatacattataggtaacataaaaaactgtccaaatagatgtacgggatataaaatattccgaca tgcaaaaatgctactttagctataagggtaaaatagttcctcaggattctaatgatttggctagattcaacatttatagcatttgtgccgcatacag atcaaaaaataccatcatcatagcatgcgactatgatatcatgttagatatagaagataaacatcagccattttatctattcccatctattgatgtttt taacgctacaatcatagaagcgtataacctgtatacagctggagattatcatctaatcatcaatccttcagataatctgaaaatgaaattgtcgttt aattcttcattctgcatatcagacggcaatggatggatcataattgatgggaaatgcaatagtaattttttatcataaaagttgtaaagtaaataata aaacaataaatattgaactagtagtacgtatattgagcaatcagaaatgatgctggtacctcttatcacggtgaccgtagttgcgggaacaatat tagtatgttatatattatatatttgtaggaaaaagatacgtactgtctataatgacaataaaattatcatgacaaaattaaaaaagataaagagttct aattccagcaaatctagtaaatcaactgatagcgaatcagactgggaggatcactgtagtgctatggaacaaaacaatgacgtagataatattt ctaggaatgagatattggacgatgatagcttcgctggtagtttaatatgggataacgaatccaatgttatggcgcctagcacagaacacattta cgatagtgttgctggaagcacgctgctaataaataatgatcgtaatgaacagactatttatcagaacactacagtagtacttaatgaagatacc aaacagaatcctaactattcatccaatcctttcgtaaattataataaaaccagtatttgtagcaagtcaaatccgttcattacagaactcaacaata aatttagtgagaataatccgtttagacgagcacatagcgatgattatcttaataagcaagaacaagatcatgaacacgatgatatagaatcatt ggtgtgattagtttcctttttataaaattgaagtaatatttagtattattgctgccgtcacgttgtacaaatggagatattccctgtattcggcatttcta aaattagcaatttattgctaataatgactgtagatattatatagatacagaacatcaaaaaattatatctgatgagatcaatagacagatggatga aacggtacttcttaccaacatcttaagcgtagaagttgtaaatgacaatgagatgtaccatcttattcctcatagattatcgacgattatactctgt attagttctgtcggaggatgtgttatctctatagataatgacgtcaatggcaaaaatattctaacctttcccattgatcatgctgtaatcatatcccc actgagtaaatgtgtcgtagttagcaagggtcctacaaccatattggttgttaaagcggatatacctagcaaacgattggtaacatcgtttacaa acgacatactgtatgtaaacaatctatcactgattaattattcgccgttgtctgtattcattattagacgagttaccgactatttggatagacacatat gcgatcagatatttgcgaataataagtggtattccattataaccatcgacaataagcagtttcctattccatcaaactgtataggtatgtcctctgc caagtacataaattctagcatcgagcaagatactttaatacatgtttgtaacctcgagcatccattcgacttagtatacaaaaaaatgcagtcgta caattctgtacctatcaaggaacaaatattgtacggtagaattgataatataaatatgagcattagtatttctgtggattaatagatttctagtatgg ggatcattaatcatctctaatctctaaatacctcataaaacgaaaaaaaagctattatcaaatactgtacggaatggattcattctcttctctttttat gaaactctgttgtatatctactgataaaactggaagcaaaaaatctgataaaaagaataagaataagatcaaggattattataaaataacaatag ttcctggttcctcttccacgtctactagctcgtggtattatacacatgcctagtaatagtctctttgcgttgacggaaagcagactagaaataaca

Fig. 59 (cont'd)

ggctaaaatgttcagacaccataatagttcccaacccagataataacagagtaccatcaacacacattcctttaaactcaatcccaaacccaaaa ccgttaaaatgtatccggccaattgatagtagataatgaggtgtacagcgcatgatgatttacacagtaaccaaaatgaaaatactttagtaatt ataagaaatatagatggtaacgtcatcatcaacaatccaataatatgccggagagtaaacattgacggataaaacaaaaatgctccgcataac tctatcatggcaataacacaaccaaatacttgtaagattcctaaattagtagaaaatacaacggatatcgatgtataagtgatctcgagaaataa taagaataaagtaatgcccgtaaagataaacatcaacattgtttggtaatcattaaaccaattagtatgaagttgaactaatttcacagtagatttt attccagtattatccccgcatgtataagtacctggtaagatatctttatattccataatcaatgagacatcactatctgataacgaatgaagtctag cactagtatgccatttacttaatattgtcgtcttggaagtttattataagttaaaatatcatggttatccaatttccatctaatatactttgtcggattat ctatagtacacggaataatgatggtatcattacatgctgtatactctatggtctttgtagttgttataacaaccaacgtatagaggtatatcaacga tattctaactcttgacatttttatttatttaaaatgataccttttgttatttattttattctattttgctaacggtattgaatggcataagtttgaaacgagtg aagaaataatttctacttacttattagacgacgtattatacacgggtgttaatggggcggtatacacattttcaaataataaactaaacaaaactg gtttaactaataataattatataacaacatctataaaagtagaggatgcggaaccaataacggaaatcccaaatgttggaaaatagacggttca gacgacccaaaacatagaggtagaggatacgctccttatcaaaatagcaaagtaacgataatcagtcacaacggatgtgtactatctgacat aaacatatcaaaagaaggaattaaacgatggagaagatttgacggaccatgtggttatgatttatacacggcggataacgtaattccaaaaga tggtttacgaggagcattcgtcgataaagatggtacttatgacaaagtttacattcttttcactgatactatcggctcaaagagaattgtcaaaatt ccgtatatagcacaaatgtgcctaaacgacgaaggtggtccatcatcattgtctagtcatagatggtcgacgtttctcaaagtcgaattagaat gtgatatcgacggaagaagttatagacaaattattcattctagaactataaaaacagataatgatacgatactatatgtattcttcgatagtcctta ttccaagtccgcattatgtacctattctatgaataccattaaacaatctttttctacgtcaaaattggaaggatatacaaagcaattgccgtctcca gctcctggtatatgtttaccagctggaaaagttgttccacataccacgtttgaagtcatagaaaaatataatgtactagatgatattataaagcctt tatctaaccaacctatcttcgaaggaccgtctggtgttaaatggttcgatataaaggagaaggaaaatgaacatcgggaatatagaatatactt cataaaagaaaattctatatattcgttcgatacaaaatctaaacaaactcgtagctcgcaagtcgatgcgcgactattttcagtaatggtaacttc gaaaccgttatttatagcagatatagggataggagtaggaatgccacaaatgaaaaaaaatacttaaaatgtaatcttaatcgagtacaccgca cgacaatgaacaaacataagacagattatgctggttatgcttgctgcgtaatatgcggtctaattgttggaattattttttacagcgacactattaaa agttgtagaacgtaaattagttcatacaccatcaatagataaaacgataaaagatgcatatattagagaagattgtcctactgactggataagct ataataataaatgtatccatttatctactgatcgaaaaacctgggaggaaggacgtaatgcatgcaaagctctaaatccaaattcggatctaatt aagatagagactccaaacgagttaagtttttaagaagcattagacgcggatattgggtaggagaatccgaaatattaaaccagacaacccc atataattttatagctaaaaatgccacgaagaatggaactaaaaaacggaaatatatttgtagtacaacgaatactcccaaactacatttttatca taccactacttcggttagatgtttagaaaaaaataaatatcgccgtaccgttcttgtttttataaaaaataacaattaacaattatcaaattttttcttta atatttacgtggttgaccattcttggtggtaaaataatctcttagtgttggaatggaatgctgtttaatgtttccgcactcatcgtatattttgacgta tgcagtcacatcgtttacgcaatagtcagactgtagttctatcatgcttcctacatcagaaggaggaacagttttaaagtctcttggttttaatctat tgccattagttttcatgaaatccttgtttatccacttcacattttaaataaatgtccactatacattcttctgttaattttactagatcgtcatgggtcat agaatttataggttccgtagtccatggatccaaactagcaaacttcgcgtatacggtatcgcgattagtgtatacaccaactgtatgaaaattaa gaaaacagtttaataaatcaacagaaatatttaatcctccgtttgatacagatgcgccatatttatggatttcggattcacacgttgtttgtctgag gtgttcgtctagtgttgcttctacgtaaacttcgattcccatatattctttattgtcagaatcgcataccgatttatcatcatacactgtttgaaaacta aatggtatacacatcaaaataataaataataacgagtacattctgcaatattgttatcgtaattggaaaaatagtgttcgagtgagttggattatgt gagtattggattgtatatttattttatattttatattttgtagtaagaatagaatgctaatgtcaagtttattccaatagatgtcttattaaaaaacatata taataaataacaatggctgaatggcataaaaattatcgaggatatctcaaaaaataataagttcgaggatgccgccatcgttgattacaagacta caaagaatgttctagctgctattcctaacagaacatttgccaagattaatcctctcatcactaatcgtaatattctaaaacctcttattggtcagaaa tattgtattgtatatactaactctctaatggatgagaacacgtatgctatggagttgcttactgggtacgcccctgtatctccgatcgttatagcga gaactcataccgcacttatattttgatgggtaagccaacaacatccagacgtgacgtgtatagaacgtgtagagatcacgctacccgtgtac gtgcaactggtaattaaaataaaaagtaatattcatatgtagtgtcaattttaaatgatgatgatgaaatggataatatccatattgacgatgtcaat aatgccggtattggcatacagttcatcgatttttagatttcattcagaggatgtggaattatgttatgggcatttgtattttgataggatctataatgt

Fig. 59 (cont'd)

agtaaatataaaatataatccgcatattccatatagatataattttattaatcgcacgttaaccgtagatgaactagacgataatgtctttttttacaca
tggttattttttaaaacacaaatatggttcacttaatcctagtttgattgtctcattatcaggaaacttaaaatataatgatatacaatgctcagtaaat
gtatcgtgtctcattaaaaatttggcaacgagtacatctactatattaacatctaaacataagacttattctctacatcggtccacgtgtattactata
ataggatacgattctattatatggtataaagatataaatgacatctatgattttactgcaatatgtatgctaatagcgtctacattgatagtgaccat
atacgtgtttaaaaaaataaaaatgaactcttaattatgctatgctattagaaatggataaaatcaaaattacggttgattcaaaaattggtaatgtt
gttaccatatcgtataacttggaaaagataactattgatgtcacacctaaaaagaaaaaagaaaaggatgtattattagcgcaatcagttgctgt
cgaagaggcaaaagatgtcaaggtagaagaaaaaaatattatcgatattgaagatgacgatgatatggatgtagaaagcgcataatacgatc
tataaaaataagtatataaatactttttatttactgtactcttactgtgtagtggtgataccctactcgattattttttaaaaaaaaatacttattctgatt
cttctagccatttccgtgttcgttcgaatgccacatcgacgttaaagatagggagtagttgaaatctagttctgcattgttggtacgcacctcaa
atgtagtgttggatatcttcaacgtatagttgttgagtagtgatggttttctaaatagaattctcttcatatcattcttgcacgcgtacatttttagcatc
catcttggaatcctagatccttgttctattcccaatggtttcatcaatagaagattaaacatatcgtacgaacacgatggagagtaatcgtagcaa
aagtaagcatttcctttaatctcagatcccggatactggatatattttgcagccaacacgtgcatccatgcagcatttcctacatataccccggcta
tgtaccgcgttatcatcgactgtacgatacataatgttaccgtgttgcttacattgctcgtaaaagactttcatcaatttgtctccttctccgtaaatt
ccagtgggtcttaggcaacaagtatacaattttgctccattcatgattacggaattattggctttcataaccagttgctcggccatacgtttacttttt
gcgtatacatgtcctggtgatatatcataaagggtatgctcatggccgatgaatggatcaccgtgtttattgggtcctattgcttccatgctacta
gtatagatcaaatacttgattcctaggtccacacaagctgccaatatagtctgtgttccataatagtttactttcatgatttcattatcggtgtatttttc
caaatacatccactagagcagctgtatgaataatcagatttaccccatctagcgcttctcttaccttatcaaagtcgtttatatcacattgtatatag
tttataaccttaactttcgaggttattggttgtggatcttctacaatatctatgactctgatttcttgaacatcatctgcactaattaacagttttactata
tacctgcctagaaatccggcaccaccagtaaccgcgtacacggccattgctgccactcataatatcagactacttattctattttactaaataat
ggctgtttgtataatagaccacgataatatcagaggagttatttactttgaaccagtccatggaaaagataaagttattggattaaaatccggaa
cgtatagtttgataattcatcgttacggagatattagtcaaggatgtgattccataggcagtccagaaatatttatcggtaacatctttgtaaacag
atatggtgtagcatatgtttatttagatacagatgtaaatatatctacaattattggaaaggcgttatctatttcaaaaaatgatcagagattagcgt
gtggagttattggtatttcttacataaatgaaaagataatacattttcttacaattaacgagaatggcgtttgatatatcagttaatgcgtctaaaac
aataaatgcattagtttactttctactcagcaaaataaattagtcatacgtaatgaagttaatgatacacactacactgtcgaatttgataggac
aaagtagttgacacgtttatttcatataatagacataatgactccatagagataagaggggtgcttccagaggaaactaatattggttgcgcggt
taatacgccggttagtatgacttacttgtataataagtatagttttaaactgattttagcagaatatataagacacagaaatactatatccggcaat
atttattcggcattgatgacactagatgatttggctattaaacagtatggagacattgatctattatttaatgagaaacttaaagtagactccgattc
gggactatttgactttgtcaactttgtaaaggatatgatatgttgtgattctagaatagtagtagctctatctagtctagtatctaaacattgggaatt
gacaaataaaaaatataggtgtatggcattagccgaacatatatctgatagtattccaatatctgagctatctagactacgatacaatctatgtaa
gtatctacgcgggcacactgagagcatagaggatgaatttgattattttgaagacgatgattcgtctacatgttctgccgtaaccgacagggaa
acggatgtataattttttttatagcgtgaaggatatgataaaaaatataattgttgtatttatcccattccaatcaccttatatgattctgtaacacaat
gaaggagtcttatagatgtatagaggtcagatactggtttgataaactgtttattccacataagtatgtttgactttatggttagacccgcatacttt
aacaaatcactgaaaattggagttaggtattgacctctcagaatcagttgccgttctggaacattaaatgtattttttatgatatactccaacgcatt
tatgtgggcatacaacaagtcattactaatggagtattccaagagaagagatttcaacagactgtttatgaactcgaatgccgcctcattgtcgc
ttatattgatgatgtcgaattctcccaatatcatcaccgatgagtagctcatcttgttatcgggatccaagttttctaaagatgtcattaaacccctcg
atcatgaatggatttatcatcatcgtttttatgttggacatgagcttagtccgtttgtccacatctatagacgacgatttctgaattatttcatatatcc
ctctctttaactccaggaacttgtcaggatggtctactttaatatgttctcgtctaagagatgaaaatctttggatggttgcacgcgacttttctcta
aaggatcctctcttaaatgaatccatcttatccttggacaagatggacagtctattttccttagatggtttaatattttttgttacccatgatctataaag
gtagacctaatcgtctcggatgaccatatatttattttcagtttattatacgcataaattgtaaaaaatatgttaggtttacaaaaatgtctcgtggg
gcattaatcgtttttgaaggattggacaaatctggaaaaacaacacaatgtatgaacatcatggaatctataccggcaaacacgataaaatatc
ttaactttcctcagagatccactgtcactggaaagatgatagatgactatctaactcgtaaaaaaacctataatgatcatatagttaatctattatttt

Fig. 59 (cont'd)

gtgcaaatagatgggagtttgcatctttatacaagaacaactagaacagggaattactttaatagttgatagatacgcattctctggagtagcg
tatgccgccgctaaaggcgcgtcaatgactctcagtaagagttatgaatctggattgcctaaacccgacttagttatattcttggaatctggtag
caaagaaattaatagaaacgtcggcgaggaaatttatgaagatgttacattccaacaaaaggtattacaagaatataaaaaaatgattgaaga
aggagatattcattggcaaattatttcttctgaattcgaggaagatgtaaagaaggagttgattaagaatatagttatagaggctatacacacgg
ttactggaccagtggggcaactgtggatgtaatagtgaaattacatttttttataaatggatgaagcatattactctggcaacttggaatcagtact
cggatacgtgtccgatatgcataccgaactcgcatcaatatctcaattagttattgccaagatagaaactatagataatgatatattaaacaagg
acattgtaaattttatcatgtgtagatcaaacttggataatccatttatctctttcctagatactgtatatactattatagatcaagagatctatcagac
cgaattgattaattcattagacgacaatgaaattatcgattgtatagttaacaagtttatgagctttataaggataacctagaaaatatagtagatg
ctatcattactctaaaatatataatgaataatccagattttaaaactacgtatgccgaagtactcggttccagaatagcggatatagatattaaaca
agtgatacgtgagaatatactacaattgtctaataatatccgcgaacgatatttgtgaaaatattaaaaaaaaatactttttttattaaatgacgtcg
cttcgcgaatttagaaaattatgctgtgatatatatcacgcatcaggatataaagaaaaatctaaattaattagagactttataacagataggat
gataaatatttgatcattaagctattgcttcccggattagacgatagaatttataacatgaacgataaacaaattataaaattatatagtataatattt
aaacaatctcaggaagatatgctacaagatttaggatacggatatataggagacactattaggactttcttcaaagagaacacagaaatccgt
ccacgagataaaagcattttaactttagaagaagtggatagtttttttaactacgttatcatccgtaactaaagaatcgcatcaaataaaattattga
ctgatatcgcatccgtttgtacatgtaatgatttaaaatgtgtagtcatgcttattgataaagatctaaaaaattaaagcgggccctcggtacgtact
taacgctattagtcctcatgcctatgatgtgtttagaaaatctaataacttgaaagagataatagaaaatgcatctaaacaaaatctagactctata
tctatttctgttatgactccaattaatcccatgttagcggaatcgtgtgattctgtcaataaggcgtttaaaaaatttccatcaggaatgtttgcgga
agtcaaatacgatggtgaaagagtacaagttcataaaaataataacgagtttgccttctttagtagaaacatgaaaccagtactctctcataaag
tggattatctcaaagaatacataccgaaagcatttaaaaaagctacgtctatcgtattggattctgaaattgttcttgtagacgaacataatgtacc
gctcccgtttggaagtttaggtatacacaaaaagaaagaatataaaaactctaacatgtgtttgttcgtgtttgactgtttgtactttgatggattcg
atatgacggacattccattgtacgaacgaagatctttctcaaagatgttatggttgaaatacccaatagaatagtattctcagagttgacgaata
ttagtaacgagtctcagttaactgacgtattggatgatgcactaacgagaaaattagaaggattggtcttaaaagatattaatggagtatacgaa
ccgggaaagagaagatggttaaaaataaagcgagactatttgaacgagggttccatggcagattctgccgatttagtagtactaggtgcttac
tatggtaaaggagcaaagggtggtatcatggcagtctttctaatgggttgttacgacgatgaatccggtaaatggaagacggttaccaagtgt
tcaggacacgatgataatacgttaagggagttgcaagaccaattaaagatgattaaaattaacaaggatcccaaaaaaattccagagtggtta
gtagttaataaaatctatattcccgattttgtagtagaggatccaaaacaatctcagatatgggaaatttcaggagcagagtttacatcttccaag
tcccataccgcaaatggaatatccattagatttcctagatttactaggataagagaggataaaacgtggaaagaatctactcatctaaacgattt
agtaaacttgactaaatcttaatagttacatacaaattaaaataacactatttagttggtggtcgccatggatggtgttattgtatactgtctaaacg
cgttagtaaaacatggcgaggaaataaatcatataaaaaatgatttcatgattaaaccatgttgtgaaaaagtcaagaacgttcacattggcgg
acaatctaaaaacaatacagtgattgcagatttgccatatatggataatgcggtatccgatgtatgcaattcactgtataaaaagaatgtatcaa
gaatatccagatttgctaatttgataaagatagatgacgatgacaagactcctactggtgtatataattatttttaaacctaaagatgccattcctgtt
attatatccataggaaaggatagagatgtttgtgaactattaatctcatctgataaagcgtgtgcgtgtatagagttaaattcatataaagtagcc
attcttcccatggatgtttccttttttaccaaaggaaatgcatcattgattattctcctgtttgatttctctatcgatgcggcacctctcttaagaagtgt
aaccgataataatgttattatatctagacaccagccgtctacatgacgagcttccgagttccaattggttcaagtttttacataagtataaagtccga
ctattgttctatattatatatggttgttgatggatctgtgatgcatgcaatagctgataatagaacttacgcaaatattagcaaaaatatattagaca
atactacaattaacgatgagtgtgagatgctgttattttgaaccacagattaggattcttgatagagatgagatgctcaatggatcatcgtgtgatat
gaacagacattgtattatgatgaatttacctgatgtaggcgaatttggatctagtatgttggggaaatatgaacctgacatgattaagattgctctt
tcggtggctggtaaaaaattgaaaataaatacaaaggttcttgagggttgtgttaaattgaaagcgagaaataatcataaataagataaacgcc
gccaccatgtctgataacggaccacagaatcagcgaaacgcaccacgcattacgtttggtggaccctcagattcaactggcagtaaccaga
atggagaacgcagtggagcgcgatctcaaacaacgtcggcctcaaggtttacccaataatactgcgtcttggttcaccgctctcactcaacatg
gcaaggaagaccttaaattccctcgaggacaaggcgttccaattaacaccaatagcagtccagatgaccaaattggctactaccgaagagc

Fig. 59 (cont'd)

taccagacgaattcgtggtggtgacggtaagatgaaagatctcagtccaagatggtatttctactacctaggaactgggccagaagctggac
ttccctatggtgctaacaaagacggcatcatatgggttgcaactgagggagccttgaatacacctaaagatcacattggcacccgcaatcctg
ctaacaatgctgcaatcgtgctacaacttcctcaaggaacaacattgcctaaaggcttctacgcagaagggagcagaggcggcagtcaagc
ctcttctcgttcctcatcacgtagtcgcaacagttcaagaaattcaactccaggcagcagtagaggaacttctcctgctagaatggctggcaat
ggcggtgatgctgctcttgctttgctgctgcttgacagattgaaccagcttgagagcaagatgtctggtaaaggccaacaacaacaaggcca
aactgtcactaagaaatctgctgctgaggcttctaagaagcctcggcagaaacgtactgccactaaagcatacaatgtaacacaagctttcg
gcagacgtggtccagaacaaacccaaggaaactttggagaccaggaactaatcagacaaggaactgattacaaacattggccgcaaattg
cacaatttgctcccagcgcttcagcgttcttcggaatgtcgcgcattggcatggaagtcacaccttcgggaacgtggttgacctacacaggtg
ccatcaaattggatgacaaagatccaaatttcaaagatcaagtcatattgctgaataagcatattgacgcatacaagacattcccaccaacaga
gcctaagaaggacaagaagaagaaggctgatgaaactcaagccttaccgcagagacagaagaaacagcaaactgtgactcttcttcctgc
tgcagatttggatgatttctccaaacaattgcaacaatccatgagcagtgctgactcaactcaggcctaaggcgcgcctttttatactagtatttg
gaaagtttttataggtagttgatagaacaaaatacataattttgtaaaaataaatcacttttttatactaatatgacacgattaccaatactttgttacta
atatcattagtatacgctacacctttttcctcagacatctcaaaaaaataggtgatgatgcaactttatcatgtaatcgaaataatacaaatgactacg
ttgttatgagtgcttggtataaggagcccaattccattattctttttagctgctaaaagcgacgtcttgtattttgataattataccaaggataaaatat
cttacgactctccatcgatgatctagttacaactatcacaattaaatcattgactgctagagatgccggtacttatgtatgtgcattctttatgaca
tcgcctacaaatgacactgataaagtagattatgaagaatactccacagagttgattgtaaatacagatagtgaatcgactatagacataatact
atctggatctacacattcaccggaaactagttctgagaaacctgattatatagataattctaattgctcgtcggtattcgaaatcgcgactccgga
accaattactgataatgtagaagatcatacagacaccgtcacatacactagtgatagcattaatacagtaagtgcatcatctggagaatccaca
acagacgagactccggaaccaattactgataaagaagaagatcatacagttacagacactgtctcatacactacagtaagtacatcatctgg
aattgtcactactaaatcaaccaccgatgatgcggatctttatgatacgtacaatgataatgatacagtaccatcaactactgtaggcggtagta
caacctctattagcaattataaaaccaaggactttgtagaaatatttggtattaccgcattaattatattgtcggccgtggcaatattctgtattacat
attatatatataataaacgttcacgtaaatacaaaacagagaacaaagtctagattttgacttacataaatgtctgggatagtaaaatctatcata
ttgagcgggccatctggtttaggaaagacagccatagccaaaagactatgggaatatatttggatttgtggtgtcccataccactagatttcctc
gtcctatggaacgagaaggtgtcgattaccattacgttaacagagaggccatctggaagggaatagccgccggaacatactgagttttttagg
aaatatttacggaacttctaaaactgctgtgaatacagccggctattaataatcgtatttgtgtgatggatctaaacatcgacggtgttagaagtttt
aaaaatacttacctaatgccttactcggtgtatataagacctacctctcttaaaatggttgagaccaagcttcgttgtagaaacactgaagcgga
tgatgagattcatcgtcgtgtgatgttggcaaaaactgacatggatgaggcaggtgaagccggtctattcgacactattatcattgaagatgat
gtgaatttagcatatagtaagttaattcagatactacaggaccgtattagaatgtatttttaacactaattagagacttaagacttaaaacttgataat
taataatataactcgtttttatatgtggctatttcaacgtctaatgtattagttaaatattaaaacttaccacgtaaaacttaaaatttaaaatgatatttc
attgacagatagatcacacattatgaactttcaaggacttgtgttaactgacaattgcaaaaatcaatgggtcgttggaccattaataggaaaag
gtggatttggtagtatttatactactaatgacaataattatgtagtaaaaatagagcccaaagctaacggatcattatttaccgaacaggcatttta
tactagagtacttaaaccatccgttatcgaagaatggaaaaaatctcacaatataaagcacgtaggtcttatcacgtgcaaggcatttggtctat
acaaatccattaatgtggaatatcgattcttggtaattaatagattaggtgcagatctagatgcggtgatcagagccaataataatagattacca
aaaaggtcggtgatgttgatcggaatcgaaatcttaaataccatacaatttatgcacgagcaaggatattctcacggagatattaaagcgagta
atatagtcttggatcaaatagataagaataaattatatctagtggattacggattggtttctaaattcatgtctaatggcgaacatgttccatttataa
gaaatccaaataaaatggataacggtactctagaatttacacctatagattcgcataaaggatacgttgtatctagacgtggagatctagaaac
acttggatattgtatgattagatggttgggaggtatcttgccatggactaagatatctgaaacaaagaattgtgcattagtaagtgccacaaaac
agaaatatgttaacaatactgcgactttgttaatgaccagtttgcaatatgcacctagagaattgctgcaatatattaccatggtaaactctttgac
atattttgaggaacccaattacgacaagtttcggcacatattaatgcagggtgtatattattaagtgtggtgtttggttgatgtaaaattttgtcgat
aaaaattaaaaaataacttaatttattattgatctcgtgtgtacaaccgaaatcatggcgatgttttacgcacacgctctcggtgggtacgacga
gaatcttcatgcctttcctggaatatcatcgactgttgccaatgatgtcagtttataataacaagtatgacattgtaaaagacaaatatatgtggtg

Fig. 59 (cont'd)

ttacagtcaggtgaacaagagatatattggagcactgctgcctatgtttgagtgcaatgaatatctacaaattggagatccgatccatgatcaa gaaggaaatcacatatcgccacaaaaactactatgctctaagcggaatcgggtacgagagtctagacttgtgtttggaaggagtagggattc atcatcacgtacttgaaacagaaaacgctgtatatggaaaagttcaacatgattattctactatcaaagagaaggccaaagaaatgaatgcact cagttcaggacctatcatcgattaccacgtctggataggagattgtatctgtcaagttactgctgtggacgtacatggaaaggaaattatgaga atgagattcaaaaagggtgcggtgcttccgatcccaaatctggtaaaagttaaacttggggagaatgatacagaaaatctttcttctactatatc ggcggcaccatcgaggtaaccacctctctggaagacagtgtgaatcatgtactcatgaaacgtttggaatctatacgccatatgtggtctgttg tatatgatcattttgatattgtgaatggtaaagaatgctgttatgtgcatacgcatttgtctaatcaaaatcttataccgagtactgtaaaaacaaatt tgtacatgaagactatgggatcatgcattcaaatgagtatcttagcgaactgaaggaatcaggtggatggagtcccagaccagaaatgcagg aatttgaatatccagatggagtggaagacactgaatcaattgagagattggtagaggagttcttcaatagatcagaacttcaggctggtaaatc tattaatgttaaacatacatctgtttcagctaagcaactaagaacacgtatactctcatcttttgccaacacagagggtggatatttgttcattgga gttgataataatacacacaaagtatttggattcacggtgggttacgactacctcagactgatagagaatgatatagaaaagcatatcaaaagac tttgtgttgtgtatttctgtgagaagaaagaggacatcaagtacacgtgtcgattcatcaaggtatataaacctggggatgaggctacctcgac atacgtgtgcgctatcaaagtggaaagatgctgttgtgctgtgtttgcagattggccagaatcatggtatcaagaagtattctccagatgaatag gtgtcacatataaaattttaattaatgtaactatagagaacaaataataggttgtaatatcatatagacaataactaacaattaattagtaactgttat ctctttttaactaactaactatacctattaatacatcgtaattatagttcttaacatctattaatcattgattcgcttctttaatttttataaaccaacattg ttaattgaaaagggataacatgttacagaatataaattatatatggatttttttaaaaaggaaatacttgactggagtgtatatttatctcttcattat atagcacgcgtgttttccaatttttccacatcccatataatacaggattataatctcgttcgaacatacgagaaagtggataaaacaatagttgatt tttatctaggttgccaaatttattccatattttagaatatggggaaaatattctacatatttattctatggatgatgctaatacgaatattataattttttt ctagatagagtattaaatattaataagaacgggtcatttatacacaatctcaggttatcatcatccattaatataaaagaatatgtatatcaattagtt aataatgatcatccagataataggataagactaatgcttgaaaatggacgtagaacaagacattttttgtcctatatatcagatacagttaatatct atatatgtattttatatagatgccgaagacagttacggttgtacattattacatagatgtatatatcactataagaaatcagaatcagaatcagaat catacaatgaattaattaagatattgttaaataatggatcagatgtagataaaaaagatacgtacggaaacacacctttatcctattatgtaaaca cgatatcaacaacgtggaattgtttgagatatgtttagagaatgctaatatagactctgtagactttaatagatatacacctcttcattatgtctcat gtcgtaataaatatgattttgtaaagttattaatttctaaaggagcaaatgttaatgcgcgtaataaattcggaactactccattttattgtggaatta tacacggtatctcgcttataaaactatatttggaatcagacacagagttagaaatagataatgaacatagtcgtcatttaataattttttgatgct gttgaatctttagattatctattatccagaggagttattgatattaactatcgtactatttacgacgctgtcagttataatgcgtataatacgttggtct atctattaaacagaaatggtgattttgagacgattactactagtggatgtacatgtatttcggaagcagtcgcaaacaacaacaaaataataatg gaagtactattgtctaaacgaccatctttgaaaattatgatacagtctatgatagcaattactaaacataaacagcataatgcagatttattgaaaa tgtgtataaaatatactgcgtgtatgaccgattatgatactcttatagatgtacaatcactacagcaatataaatggtatattttaagatgtttcgatg aaatagatatcatgaagagatgttatataaaaaataaaactgtattccaattagtttttttgtatcaaagacattaatactttaatgagatacggtaaa catccttcttcgtgaagtgcactagtctcgacgtatacggaagtcgtgtacgtaatatcatagcatctattagatatcgtcagagattaattagtc tattatccaagaagctggatcctggagataaatggtcgtgttttcctaacgaaataaaatataacgataacgaactgtccacatatctaaaaatct tataaacactattaaaatataaaatcacactacatcattgtttcctttttagtgctcgacagtgtatactattttttaacgctcataaataaaaatgaaaa cgatttccgttgttacgttgttatgcgtactacctgctgttgtttattcaacatgtactgtacccactatgaataacgctaaattaacgtctaccgaa acatcgtttaataataaccagaaagttacgtttacatgtgatcagggatatcattcttcggatccaaatgctgtctgcgaaacagataaatggaa atacgaaaatccatgcaaaaaaatgtgcacagtttctgattacatctctgaactatataataaaccgctatacgaagtgaattccaccatgacac taagttgcaacggcgaaacaaaatattttcgttgcgaagaaaaaaatggaaatacttcttggaatgatactgttacgtgtcctaatgcggaatgt caacctcttcaattagaacacggatcgtgtcaaccagttaaagaaaaatactcatttggggaatatataactatcaactgtgatgttggatatga ggttattggtgcttcgtacataagttgtacagctaattcttggaatgttattccatcatgtcaacaaaaatgtgatataccgtctctatctaatggatt aatttccggatctacattttctatcggtggcgttatacatcttagttgtaaaagtggtttttatactaacgggatctccatcatccacatgtatcgacg gtaaatggaatcccatactcccaacatgtgtacgatctaacgaaaaatttgatccagtggatgatggtcccgacgatgagacagatttgagca

Fig. 59 (cont'd)

aactctcgaaagacgttgtacaatatgaacaagaaatagaatcgttagaagcaacttatcatataatcatagtggcgttaacaattatgggcgt
catattttaatctccgttatagtattagtttgttcctgtgacaaaaataatgaccaatataagttccataaattgctaccgtgaatataaatccgttaa
aataatgaataattaataattaataatttaataacaaacaagtatcaaaagattaaagacttatagctagaatcaattgagatgtcttcttcagtgg
atgttgatatctacgatgccgttagagcattttactcaggcactattataacaagagatttattgtgtatggaagaagtaacgccatattacataa
tatatacaggctatttacaagatgcgccgttataccgttcgatgatatagtacgtactatgccaaatgaatcacgtgttaaacaatgggtgatgg
atacacttaatggtataatgatgaatgaacgcgatgtttctgtaagcgttggcaccggaatactattcatggaaatgtttttcgattacaataaaaa
tagtatcaacaatcaactaatgtatgatataattaatagcgtatctataattctagctaatgagagatatagaagcgcttttaacgacgatggtata
tacatccgtagaaatatgattaacaagttgtacggatacgcatctctaactactattggcacgatcgctggaggtgtttgttattatctgttgatgc
atctagttagtttgtataaataattatttcaatatactagttaaaattttaagattttaaatgtataaaaaactaataacgtttttatttgtaataggtgcat
tagcatcctattcgaataatgagtacactccgtttaataaaactgagtgtaaaactctatatagatggagtagataatatagaaaattcatatactga
tgataataatgaattggtgttaaattttaaagagtacacaatttctattattacagagtcatgcgacgtcggatttgattccatagatatagatgttat
aaacgactataaaattattgatatgtctactattcaacgcagaggtcacacgtgtagaatatctaccaaattatcatgccattatgataagtaccct
tatattcacaaatatgatggtgatgagcgacaatattctattactgcagagggaaaatgctataaaggaataaaatatgaaataagtatgatcaa
cgatgatactctattgagaaaacatactcttaaaattggatctacttatatatttgatcgtcatggacatagtaatacatattattcaaaatatgatttt
taaaaatttaaaatatattatcacttcagtgacagtagtcaaataacaaacaacaccatgagatatattataattctcgcagtttgttcattaatagt
atacacgctaaaataactagttataagtttgaatccgtcaattttgattccaaaattgaatggactggggatggtctatacaatatatcccttaaaa
attatggcatcaagacgtggcaaacaatgtatacaaatgtaccagaaggaacatacgacatatccgcatttccaaagaatgatttcgtatctttc
tgggttaaatttgaacaaggcgattataaagtggaagagtattgtacgggaccaccgactgtaacattaactgaatacgacgaccatccgtat
gctactagaggtagcaaaaagattcctatttacaaacgcggtgacatgtgtgatatctacttgttgtatacggctaacttcacattcggagattct
aaagaaccagtaccatatgatatcgatgactacgattgcacgtctacaggttgcagcatagactttgtcacaacagaaaaagtgtgcgtgaca
gcacagggagccacagaagggtttctcgaaaaaaattactccatggagttcgaaagtatgtctgacacctaaaaagagtgtatatacatgcgc
aattagatccaaagaagatgttcccaatttcaaggacaaaatggccagagttatcaagagaaaatttaactaaatttctcggtagcacatcaaa
tgatgttaccacttttcttagcatgcttaacttgactaaatattcataactaattttattaatgatacaaaaacgaaataaaactgcatattatacact
ggttaacgcccttataggctctaaccattttcaagatgaggtccctgattatagtccttctgttcccctctatcatctactccatgtctattagacgat
gtgagaagactgaagaggaaacatggggattgaaaataggggttgtgtataattgccaaagatttctatcccgaaagaactgattgcagtgttc
atctcccaactgcaagtgaaggcaatggattcagggatatacgaaacaccgataaattataaaaaaagcaatgtgtccgctgtttccgttaata
atactattttcgtaactggcggattattcataaataactctaatagcacgatcgtggttaacaatatggaaaaacttgacatttataaagacaaac
aatggtcgattatagaaatgcctatggctagggtatatcacggcatcgactcgacatttggaatgttatattttgccggaggtctatccgttaccg
aacaatatggtaatttagagaaaaacaacgagatatcttgttacaatcctagaacgaataagtggtttgatatttcatatactatttataagatatcc
atatcatcattgtgtaaactaaataacgtcttctatgtatttagtaaggacattggatatgtggaaaagtatgatggtctccccgctataaaggcat
tatcaacttctccttattgattgaaaatgaaaatataaaatagttttatgtatagcagtattaccctatagtttttattgcttactactaacatggatacag
atacagatgttacaaatgtagaagatatcatgaatgaaatagatagagagaagaagaaatactaaaaaatgtagaaattgaaaataataaaa
acattaacaagaatcatcccaatgaatatattagagaagcactcgttattaatacaagtagtaatagtgattccattgataaagaagttatagaat
gtatcagtcacgatgtaggaatatagatcatatctactaattttataatcaatacaaaacataaaaaacaactcgttattacatagcaggcatgg
aatccttcaagtattgttttgataacgatggcaagaaatggattatcggaaatactttatattctggtaattcaatactctataaggtcagaaaaaat
ttcactagttcgttctacaattacgtaatgaagatagatcacaaatcacacaagccattgttgtctgaaatacgattctatatatctgtattggatcc
tttgactatcgacaactggacacgggaacgtggtataaagtatttggctattccagatctgtatggaattggagaaaccgatgattatatgttctt
cgttataaagaatttgggaagagtattcgccccaaaggatactgaatcagtcttcgaagcatgcgtcactatgataaacacgttagagtttatac
actctcgaggatttacccatggaaaaatagaaccgaggaatatactgattagaaataaacgtctttcactaattgactattctagaactaacaaa
ctatacaagagtggaaactcacatatagattacaacgaggacatgataacttcaggaaatatcaattatatgtgtgtagacaatcatcttggag
caacagtttcaaaacgaggagatttagaaatgttgggatattgcatgatagaatggttcggtggcaaacttccatggaaaaacgaaagtagta

Fig. 59 (cont'd)

taaaagtaataaaacaaaaaaaagaatataaaaaatttatagctactttctttgaggactgttttcctgaaggaaatgaacctctggaattagtta
gatatatagaattagtatacacgttagattattctcaaactcctaattatgacagactacgtagactgtttatacaagattgaaatattctttttttata
gagtgtggtagtgttacggatatctaatattaatattagactatctctatcgcgctacacgaccaatatcgattactatggatatcttctatgaaag
gagagaatgtattcatttctccagcgtcaatctcgtcagtattgacaatactgtattatggagctaatggatccactgctgaacagctatcaaaat
atgtagaaaaggaggagaacacggataaggttagcgctcagaatatctcattcaaatccatgaataaagtatatgggcgatattctgccgtgt
ttaaagattccttttttgagaaaaattggcgataagtttcaaactgttgacttcactgattgtcgcactatagatgcaatcaacaagtgtgtagatat
ctttactgaggggaaaatcaatccactattggatgaacaattgtctcctagcaattagtgccgtatactttaaagcaaaatggttgacgccattc
gaaaaggaatttaccagtgattatccctttttacgtatcaccaacggaaatggtagacgtaagtatgatgtctatgtacggcgagctatttaatca
cgcatctgtaaaagaatcattcggtaacttttcaatcatagaactgccatatgttggagatactagtatgatggtcattcttccagacaagattgat
ggattagaatccatagaacaaaatctaacagatacaaattttaagaaatggtgtaactctctggaagctacgtttatcgatgttcacattcccaa
gtttaaggtaacaggctcgtataatctggtggatactctagtaaagtcaggactgacagaggtgttcggttcaactggagattatagcaatatgt
gtaatttagatgtgagtgtcgacgctatgatccacaaaacgtatatagatgtcaatgaagagtatacagaagcagctgcagcaacttgtgcact
ggtgtcagactgtgcatcaacaattacaaatgagttctgtgtagatcatccgttcatctatgtgattaggcatgttgatggaaaaattttttcgttg
gtagatattgctctccgacaactaattgttaaccatttttttttaaaaaaatagaaaaaacatgtggtattagtgcaggtcgttattcttccaattgcaa
ttggtaagatgacggccaactttagtacccacgtcttttcaccacagcactgtggatgtgacagactgaccagtattgatgacgtcaaacaatg
tttgactgaatatatttattggtcgtcctatgcataccgcaacaggcaatgcgctggacaattgtattccacactcctctcttttagagatgatgcg
gaattagtgttcatcgacattcgcgagctggtaaaaaatatgccgtgggatgatgtcaaagattgtgtagaaatcatccgttgttatataccgga
tgagcaaaaaaccatcatcggactttgtgcatatgctgctacttactggggaggtgaagaccatcccactagtaacagtctgaacgcattgttt
gtgatgcttgagatgctaaattacgtggattataacatcatattccggcgtatgaattgatgagttgtacatcttgacattttcttctttcttctcttctc
cctttcccagaaacaaactttttttacccactataaaataaaatgagtatactacctgttatatttctttctatatttttttattcttcattcgttcagacttt
aacgcgcctgaatgtatcgacaaaggggcaatattttgcatcattcatggagttagaaaacgagccagtaatcttaccatgtcctcaaataaata
cgctatcatccggatataatatattagatattttatgggaaaaacgaggagcggataatgatagaattataccgatagataatggtagcaatatg
ctaattctgaacccgacacaatcagactctggtatttatatatgcattaccacgaacgaaacctactgtgacatgatgtcgttaaatttgacaatc
gtgtctgtctcagaatcaaatatagatcttatctcgtatccacaaatagtaaatgagagatctactggcgaaatggtatgtcccaatattaatgca
tttattgctagtaacgtaaacgcagatattatatggagcgggcatcgacgccttagaaataagagacttaaacaacggacacctggaattatta
ccatagaagatgttagaaaaaatgatgctggttattatacatgtgtttaagaatatatatacggtggcaaaacatataacgtaaccagaattgtaa
aattagaggtacgggataaaataatacctctactatgcaattaccagaaggtgttgtaacttcaataggtagtaatttgactattgcgtgtagag
tatcgttgagacctcccacaacggatgcagacgtctttggataagtaatggtatgtattacgaagaagatgatggggacggagacggtaga
ataagtgtagcaaataaaatctatatgaccgataagagacgtgttattacatcccggttaaacattaatcctgtcaaggaagaagatgctacaa
cgtttacgtgtatggcgtttactattcctagcatcagcaaaacagttactgttagtataacgtgaatgtatgttgttacatttccatgtcaattgagttt
ataagaatttttatacattatcttccaacaaacaattgacgaacgtattgctatgattaactcccacgatactatgcatattattaatcattaacttgc
agactatacctagtgctattttgacatactcatgttcttgtgtaattgcggtatctatattattaaagtacgtaaatctagctatagtttattatttaattt
tagataatataccgtctccttattttttaaaaaattgccacatcctttattaaatcatgaatgggaatttctatgtcatcgttaatatattgtgaacaacaa
gagcagatatctataggaaagggtggaatgcgatacattgatctatgtagtttttaaaacacacgcgaactttgaagaatttatataaatcattcc
atcgatacatccttctatgttgacatgtatatatccaggaattctttattaatgtcaggaaatgtataaactaaaacattgcccgaaagcggtgcc
tctatctgcgttatatccgttcttaacttacaaaatgtaaccaataccttttgcatgacttgttttgttcggcaacgttagtttaaacttgacgaatggat
taattacaatagcatgatccgcgcatctattaagttttttttactttaacgcccttgtatgttttacagagactttatctaaatttctagtgcttgtatgtg
ttataaatataacgggatatagaactgaatcacctaccttagatacccaattacattttatcagatccagataataaacaaattttgtcgccctaac
taattctatattgttatatattttacaattggttatgatatcatgtaataacttggagtctaacgcgcatcgtcgtacgtttatacaattgtgattagtgt
agtatatctacacatgtattttttccgcactatagtattctggactagtgataaaactatcgttatatctgtcttcaatgaactcatcgagatattgctct
ctgtcatattcatacacctgcataaactttctagacatcttacaatccgtgttattttaggatcatatttacatatttacgggtatatcaaagatgttag

Fig. 59 (cont'd)

attagttaatgggaatcgtctataataatgaatattaaacaattatatgaggactttaccacaaagcatcataaaaatgagtcgtcgtctgatttat
gttttaaatatcaaccgcgaatcaactcataaaatacaagagaatgaaatatatacatattttagtcattgcaatatagaccatacttctacagaac
ttgattttgtagttaaaaactatgatctaaacagacgacaacctgtaactgggtatactgcactacactgctatttgtataataattactttacaaac
gatgtactgaagatattattaaatcatggagtggatgtaacgatgaaaaccagtagcggacgtatgcctgtttatatattgcttactagatgttgt
aatatttcacatgatgtagtgatagatatgatagacaaagataaaaaccacttatcgcatagagactattccaacctactactagagtatataaa
atctcgttacatgttattgaaggaagaggatatcgatgagaacatagtatccactttattagataagggaatcgatcctaactttaaacaagacg
gatatacagcgttacattattattatttgtgtctcgcacacgtttataaaccaggtgagtgtagaaaaccgataacgataaaaaaggccaagcg
aattatttctttgtttatacaacatggagctaatctaaacgcgttagataattgtggtaatacaccattccatttgtatcttagtattgaaatgtgtaat
aatattcatatgactaaaatgctgttgactttaatccgaatttcaaaatatgtaataatcatggattaacgcctatactatgttatataacttccgact
acatacaacacgatattcttgttatgttaatacatcactatgaaacaaatgttggagaaatgccgatagatgagcgtcgtataatcgtattcgagt
ttatcaaaacatattctacacgtccggcagattcgataacttatttgatgaataggtttaaaaatatagatatttatacccgctatgaaggaaagac
attattacacgtagcatgtgaatataataatacacacgtaatagattatcttatacgtatcaacggagatataaaatgcgttaaccgacaataacaa
acacgctacacaactcattatagataacaaagaaaattccccataccattaattgtttactgtatatacttagatatattgtagataagaatgtga
taagatcgttggtggatcaacttccatctctacctatcttcgatataaaatcatttgagaaattcatatcctactgtatactttagatgacacatttta
caatagacacgttaggaatcgcaattctaaaacgtatcgatacgcattttcaaaatacatgtcgtttgataaatacgatggtataataactaaatg
tcataaagaaacaatattgctcaaactatccactgttctagacactacactatatgcagttttaagatgccataattcgaaaaagttaagaagata
cctcaacgagttaaaaaaatataataacgataagtcctttaaaatatattctaatattatgaatgagagataccttaatgtatattataaagatatgt
acgtgtcaaaggtatatgataaactatttcctgttttcacagataaaaattgtctactaacattactaccttcagaaattatatacgaaatattataca
tgctgacaattaacgatctttataatatatcgtatccacctaccaaagtatagttgtattttctcatgcgatgtgtgtaaaaaaactgatattatataa
atattttagtgccgtataatgaagatgacgatgaaaatgatggtacatatatatttcgtatcattattgttattgctattccacagttacgccatagac
atcgaaaatgaaatcacagaattcttcaataaaatgagagatactctaccagctaaagactctaaatggttgaatccagcatgtatgttcggag
gcacaatgaatgatatagccgctctaggagagccattcagcgcaaagtgtcctcctattgaagacagtctttatcgcacagatataaagacta
tgtggttaaatgggagaggctagaaaaaaatagacggcgacaggtttctaataaaacgtgttaaacatggtgatttatggatagccaactatac
atctaaattcagtaaccgtaggtatttgtgtaccgtaactacaaagaatggtgactgtgttcagggtatagttagatctcatattaaaaaaacctcct
tcatgcattccaaaaacatatgaactaggtactcatgataagtatggcatagacttatactgtggaattcttacgcaaaacattataataatataa
cttggtataaagataataaggaaattaatatcgacgatattaagtattcacaaacgggaaagaaattaattattcataatccagagttagaagat
agtggaagatacaactgttacgttcattacgacgacgttagaatcaagatgtaaaatacttacggttataccgtcgcaagaccacaggtttaaa
ctaatactagatccaaaaatcaacgtaacgataggagaacctgccaatataacatgcactgctgtgtcaacgtcattattgattgacgatgtact
gattgaatgggaaaatccatccggatggcttataggattcgattttgatgtatactctgttttaactagtagaggcggtatcaccgaggcgacct
tgtactttgaaaatgttactgaagaatatataggtaatacatataaatgtcgtggacacaactattattttgaaaaaaacccttacaactacagtagt
attggagtaaatacacaatgcattttatatacattactgaataattattattattatttatatcgtatttgtgctataacgcgactatctaggtatttgtat
ctcaccgatagagaacatataaatgtagactctattaaacagttgtgtaaaatatcagatcctaatagatgtggatgtacggctttagaaatgag
ttcattaaaatatgtgatatcaacggaacatatttatataattatactattgctgttagtataattattgattccacggaagaactaccaacagttact
ccaattacaacaacatataattatactatcgatgatagcactactgaagaactacaagtgactcctcatatggatctccatcgatgatacatgtat
taaaatactttccgaataagtcttttaaatattgtattaattatgaaaaactatgctatgcgagtatgatacgatactagatttatctctagcgagag
atgtcgttagaatcatttatcaacgaatatcgataacatgtgtcatttatacgttaaagtctgtccgtcttctctattgtttagactgtttgtagaatgct
gtgatataaacaaactagtagacacaaatatttaactcatgatgaagttgagaatgatatgctttagctaatataaaaatatattaatccactatat
attctagacttgatttaaaaccgataaactactactacgtactgtataagttaggagcagaccctaattatgtagatgatagaggtaatacttctg
catctatatgtccacttatgagaaaacgtcatttaataagatgcatcgtgaaaagaaatttattaaagagttggtaaaatatgaaaccgaaagta
aataatataggaaatacacctctacataactacgtatctcaatatgatatcactctcattcctcatccacaacccattaaaaaaatggaaattaaag
ccctctattagcataaacggctacaggtctacctttacaatggcctttccttgtgcccagttcagaccctgtcattgccacgctactaaggactc

Fig. 59 (cont'd)

cctgaataccgtggccgacgtcagacattgtctgactgaatacatcctgtgggtttctcatagatggacccatagagaaagcgcagggtctct
ctacaggcttctcatctctttcagaactgatgcaacggagctctttggtggtgagttgaaggattcacttccgtggagatcattaaatgactccat
gaaaaccgccgaagaacttcgtgcaatcattggactttgtactcaatcagctatcgtctctggaagagtcttcaacgataagtatatcgacata
ctacttatgctgcgaaagattctgaacgagaacgactatctcaccctcttggatcatatccgcactgctaaatactaaatctccttcatgctctctc
actacactttttatcatcttatgaggaataattagcaccagaatagctatggattgcacatgtattctatgtcgtctactggatgaagatgtgacgt
acaaaaaaataaaactagaaattgaaacgtgtcacaacttatcaaaacatatagatagacgaggaaacaatgcgctacattgttacgtctcca
ataaatgcgatacagacattaagattgttcgactgttactctctcgcggagtcgagagactttgtagaaacaacgaaggattaactccgctagg
agcatacagtaagcatagatacgtaaaatctcagattgtgcatctactgatatccagctattcgaattcctctaacgaactcaagtcgaatataa
atgatttcgacttacgtctgctaaaatacctaattgtggataaacggatacgtccgtccaagaatacgaattatgcaatcaatggtctcggattg
gtggatatatacgtaacgacgcctaatccgagaccagaagtattgctatggcttcttaaatcagaatgttacagcaccggttacgtatttcgtac
ctgtatgtacaacagtgatatgtgtaagaactctcttcattactatatatcgtctcatagagaatctctatccaaggatgtaattaaatgtttgatcg
ataacaatgtttccatccaatactactggtcttgctcaaccatagatatagagattattaataaaggatgtggacacgtgtagagtatacgacgtc
agccctatattagaggcgtattatctaaacaagcgatttagagtaaccccatataatgtagacatggaaatcgttaatcttcttattgagagacgt
catactcttgtcgacgtaatgcgtagtattacttcgtacgattccagagaatataaccactacatcatcgataacattctaaagagatttagacaa
caggatgaatccatcgtacaagccatactgataaactacttacattacggcgatatggtaagtatacctatcattcaatgcatgttggataagac
gacggacaacaactttgttaataataatctcgtcgatgtaaacgtcgtaaggtttatcgtggaaaatatggacacgcggctgtaaatcacatatc
taacaatggccgtctatgtatgtacggtctgatattatcgagatttaataattgcgggtatcactgttatgaagatgtatttgatatactaagcaagt
acatggatgatatagatatgatcgataactctactatattacgcggtcgatgtcaataatatacaatttgcaaagcggttattggaatatggagcg
agtgtcacgctcgataatcaatacggccatccagaaaagcagttaccaaagagaagctagttgatttattactgagttaccatcccactctaga
gactatgattgacgcatttaatagagatatacgctatctatatcctgaaccattattcgcctgtatcagatacgccttaatcctagatgatgattttc
cttctaaagtaagtatgatatcgccggtcgtcataaggaactaaagcgctatagagcagacattaatagaatgaagaatgcctacatatcagg
cgtctccatgtttgatatattatttaaacgaagcaaacgccacagattgagatacgcaaagaacaatgagaggatcgactccattaaataattta
tcatggagtgataatgtcctgtttccatggcatattacaaaatcgattccgtccaagatgataaaaacatttaccggcatcataaacacggagttt
atttatatgtctcgcataaacattactaaaaaaatatattgttcggttttctttcacatctttaattatgaaaaagtaaatcattatgagatggacgca
tcgttcgcgacagtatgtggtacatacctaacgtatttatggacgacggtaagaatgaaggtcacgtttctgtcaacaatgtcgacgcgatcgt
gtaacacgactcacaatagaatctgtgaatgctctcccgatcatggatgcaaggcatgtgtttcccaaacaaaatgtggaataggatacgga
gtatccggagacgtcatctgttctccgtgtggtctcggaacatattctcacaccgtctcttccgcagataaatgcgaacccgtacccagaaata
cctttaactatatcgatgtggaaattaacctgtatccagttaacgacacatcgtgtactcggacgaccactaccggtctcagcgaatccatctca
acgtcggaactaactattactatgaatcataaagactgcgatcccgtcttcttaataaggtagcgacttcaggtttctttacaggagaaaggtgt
gcactctgaatttcgagattaaatgcaataacaaagattcttcctccaaacagttaacgaaagcaaagaatgatactatcatgccgcattcgga
gacagtaactctagcgtcgacatctatatactatatagtaataccaatactcaagactacgaaactgatacaatctcttatcatgtgggtaatgta
gccatatgcccggtagttgcgatatacataaactgatcactaattccaaacccacccgctttttatagtaagttttcacccataaatacaataatt
aatttctcgtaaaagtagaaaatatattctaatttattgcacggtaaggaagtagaatcataaagaacagtactcaatcaatagcaatcatgaaa
caatatatcgtactggcatgcatgtgcctgccagtcttcagcaatcatcctcatcgtgtacggaagaagaaaacaaacatcatatgggaatcg
atgttattatcaaagtcacaaagcaagaccaaacaccgaccgatgataagatttgccaatccgtaacggaaattacagagtccgagtcagat
ccagatcccgaggtggaatcagtcgaggatgtagatcctcctaccacttattactccatcatcggtggaggtctgagaatgaactttggattca
ccaaatgtcctcagattaaatccatctcagaatccgctgatggaaagactgtgaggtgtctatcgacatcagatgtagcgaagaagagaaag
acagcgacatcaagacccatccagtactcgggtctaacatctctcataagaaagtgagttacgaagatatcatcggttcaacgatcgtcgata
caaaatgtgtcaagaatctagagtttagcgttcgtatcggagacatgtgcaaggaatcatctgaacttgaggtcaagtatgtcgacggatcgg
catctgaaggtgcaaccgatgatacttcactcatcgattcaacaaaactcaaagcgtgtgtctgaatcgataactctattcatctgaaattggat
gagtagggttaatcgaacgattcaggcacaccacgaattaaaaaagtgtaccggacactatattccggtttgcaaaacaaaaagttacctctc

Fig. 59 (cont'd)

gcgacttcttctttttctgtctcaatagtgtgatacgattatgacactattcctatttcctttcagggtatcacaaaaatattaaacctctttctgatggt
ctcatacaaaaatattttattctctttctctctttgatggtctcataaaaaatattttattctctttctctctttgatggtctcataaaatattttattctcttt
ctctctttgatggtctcataaaaaatattttattctctttctctctttgatggtctcataaaatattttattctctttctctctttgatggtctcataaaaaat
attttattctctttctctctttgatggtctcataaaa

Fig. 60 atgtttgttttcttgttttattgccactagtctctagtcagtgtgttaatcttacaaccagaactcaattacccctgcatacactaattctttcacac
gtggtgtttattaccctgacaaagttttcagatcctcagttttacattcaactcaggacttgttcttacctttcttttccaatgttacttggttccatgct
atacatgtctctgggaccaatggtactaagaggtttgataaccctgtcctaccatttaatgatggtgtttattttgcttccactgagaagtctaaca
taataagaggctggattttggtactactttagattcgaagacccagtccctacttattgttaataacgctactaatgttgttattaaagtctgtgaat
ttcaattttgtaatgatccatttttgggtgtttattaccacaaaaacaacaaaagttggatggaaagtgagttcagagtttattctagtgcgaataat
tgcacttttgaatatgtctctcagccttttcttatggaccttgaaggaaaacagggtaatttcaaaaatcttagggaatttgtgtttaagaatattga
tggttattttaaaatatattctaagcacacgcctattaatttagtgcgtgatctccctcagggttttttcggctttagaaccattggtagatttgccaat
aggtattaacatcactaggtttcaaactttacttgctttacatagaagttatttgactcctggtgattcttcttcaggttggacagctggtgctgcag
cttattatgtgggttatcttcaacctaggactttttctattaaaatataatgaaaatggaaccattacagatgctgtagactgtgcacttgaccctctc
tcagaaacaaagtgtacgttgaaatccttcactgtagaaaaaggaatctatcaaacttctaactttagagtccaaccaacagaatctattgttag
atttcctaatattacaaaacttgtgcccttttggtgaagtttttaacgccaccagatttgcatctgtttatgcttggaacaggaagagaatcagcaac
tgtgttgctgattattctgtcctatataattccgcatcattttccactttttaagtgttatggagtgtctcctactaaattaaatgatctctgctttactaat
gtctatgcagattcatttgtaattagaggtgatgaagtcagacaaatcgctccagggcaaactggaaagattgctgattataattataaaattacc
agatgattttacaggctgcgttatagcttggaattctaacaatcttgattctaaggttggtggtaattataattacctgtatagattgtttaggaagt
ctaatctcaaacctttgagagagatatttcaactgaaatctatcaggccggtagcacaccttgtaatggtgttgaaggtttttaattgttactttcct
ttacaatcatatggtttccaacccactaatggtgttggttaccaaccatacagagtagtagtactttctttgaacttctacatgcaccagcaactg
tttgtggacctaaaaagtctactaatttggttaaaaacaaatgtgtcaatttcaacttcaatggtttaacaggcacaggtgttcttactgagtctaa
caaaaagtttctgcctttccaacaatttggcagagacattgctgacactactgatgctgtccgtgatccacagacacttgagattcttgacatta
caccatgttcttttggtggtgtcagtgttataacaccaggaacaaatacttctaaccaggttgctgttctttatcaggatgttaactgcacagaag
tccctgttgctcattcatgcagatcaacttactcctacttggcgtgtttattctacaggttctaatgttttttcaaacacgtgcaggctgtttaataggg
gctgaacatgtcaacaactcatatgagtgtgacatacccattggtgcaggtatatgcgctagttatcagactcagactaattctcctcggcgggg
cacgtagtgtagctagtcaatccatcattgcctacactatgtcacttggtgcagaaaattcagttgcttactctaataactctattgccatacccca
caaattttactattagtgttaccacagaaattctaccagtgtctatgaccaagacatcagtagattgtacaatgtacatttgtggtgattcaactga
atgcagcaatcttttgttgcaatatggcagttttttgtacacaattaaaccgtgctttaactggaatagctgttgaacaagacaaaaacacccaag
aagtttttgcacaagtcaaacaaatttacaaaacaccaccaattaaagattttggtggttttaattttttcacaaatattaccagatccatcaaaacc
aagcaagaggtcatttattgaagatctactttttcaacaaagtgacacttgcagatgctggcttcatcaaacaatatggtgattgccttggtgatat
tgctgctagagacctcatttgtgcacaaaagtttaacggccttactgttttgccaccttttgctcacagatgaaatgattgctcaatacacttctgc
actgttagcgggtacaatcacttctggttggaccttggtgcaggtgctgcattacaaataccatttgctatgcaaatggcttataggtttaatgg
tattggagttacacagaatgttctctatgagaaccaaaaattgattgccaaccaatttaatagtgctattggcaaaattcaagactcactttcttcc
acagcaagtgcacttggaaaacttcaagatgtggtcaaccaaaatgcacaagctttaaacacgcttgttaaacaacttagctccaattttggtg
caatttcaagtgtttttaaatgatatcctttcacgtcttgacaaagttgaggctgaagtcaaattgatagttgatcacaggcagacttcaaagtt
tgcagacatatgtgactcaacaattaattagagctgcagaaatcagagcttctgctaatcttgctgctactaaaatgtcagagtgtgtacttgga
caatcaaaaagagttgattttgtggaaagggctatcatcttatgtccttccctcagtcagcacctcatggtgtagtcttcttgcatgtgacttatgt
ccctgcacaagaaaagaacttcacaactgctcctgccatttgtcatgatggaaaagcacacttcctcgtgaaggtgtctttgtttcaaatggc
acacactggtttgtaacacaaaggaattttttatgaaccacaaatcattactacagacaacacatttgtgtctggtaactgtgatgttgtaatagga
attgtcaacaacacagtttatgatcctttgcaacctgaattagactcattcaaggaggagttagataaatattttaagaatcatacatcaccagat
gttgatttaggtgacatctctggcattaatgcttcagttgtaaacattcaaaaagaaattgaccgcctcaatgaggttgccaagaatttaaatga
atctctcatcgatctccaagaacttggaaagtatgagcagtatataaaatggccatggtacatttggctaggttttatagctggcttgattgccat
agtaatggtgacaattatgctttgctgtatgaccagttgctgtagttgtctcaagggctgttgttcttgtggatcctgctgcaaatttgatgaagac
gactctgagccagtgctcaaaggagtcaaattacattacacataa

Fig. 61

MFVFLVLLPLVSSQCVNLTTRTQLPPAYTNSFTRGVYYPDKVFRSSVLHSTQDLFLPFFS
NVTWFHAIHVSGTNGTKRFDNPVLPFNDGVYFASTEKSNIIRGWIFGTTLDSKTQSLLIV
NNATNVVIKVCEFQFCNDPFLGVYYHKNNKSWMESEFRVYSSANNCTFEYVSQPFLMD
LEGKQGNFKNLREFVFKNIDGYFKIYSKHTPINLVRDLPQGFSALEPLVDLPIGINITRFQ
TLLALHRSYLTPGDSSSGWTAGAAAYYVGYLQPRTFLLKYNENGTITDAVDCALDPLS
ETKCTLKSFTVEKGIYQTSNFRVQPTESIVRFPNITNLCPFGEVFNATRFASVYAWNRKRI
SNCVADYSVLYNSASFSTFKCYGVSPTKLNDLCFTNVYADSFVIRGDEVRQIAPGQTGK
IADYNYKLPDDFTGCVIAWNSNNLDSKVGGNYNYLYRLFRKSNLKPFERDISTEIYQAG
STPCNGVEGFNCYFPLQSYGFQPTNGVGYQPYRVVVLSFELLHAPATVCGPKKSTNLV
KNKCVNFNFNGLTGTGVLTESNKKFLPFQQFGRDIADTTDAVRDPQTLEILDITPCSFGG
VSVITPGTNTSNQVAVLYQDVNCTEVPVAIHADQLTPTWRVYSTGSNVFQTRAGCLIGA
EHVNNSYECDIPIGAGICASYQTQTNSPRRARSVASQSIIAYTMSLGAENSVAYSNNSIAI
PTNFTISVTTEILPVSMTKTSVDCTMYICGDSTECSNLLLQYGSFCTQLNRALTGIAVEQD
KNTQEVFAQVKQIYKTPPIKDFGGFNFSQILPDPSKPSKRSFIEDLLFNKVTLADAGFIKQ
YGDCLGDIAARDLICAQKFNGLTVLPPLLTDEMIAQYTSALLAGTITSGWTFGAGAALQ
IPFAMQMAYRFNGIGVTQNVLYENQKLIANQFNSAIGKIQDSLSSTASALGKLQDVVNQ
NAQALNTLVKQLSSNFGAISSVLNDILSRLDKVEAEVQIDRLITGRLQSLQTYVTQQLIR
AAEIRASANLAATKMSECVLGQSKRVDFCGKGYHLMSFPQSAPHGVVFLHVTYVPAQE
KNFTTAPAICHDGKAHFPREGVFVSNGTHWFVTQRNFYEPQIITTDNTFVSGNCDVVIGI
VNNTVYDPLQPELDSFKEELDKYFKNHTSPDVDLGDISGINASVVNIQKEIDRLNEVAK
NLNESLIDLQELGKYEQYIKWPWYIWLGFIAGLIAIVMVTIMLCCMTSCCSCLKGCCSC
GSCCKFDEDDSEPVLKGVKLHYT

Fig. 62 atgtttgtctttcttgtcttattgccactagtctctagtcagtgtgttaatcttacaaccagaactcaattaccacctgcatacactaattctttcacac
gtggtgtttattaccctgacaaagtattcagatcctcagtattacattcaactcaggacttgttcttacctttcttctccaatgttacttggttccatgc
tatacatgtctctgggaccaatggtactaagaggtttgataaccctgtcctaccatttaatgatggtgtttatttcgcttccactgagaagtctaac
ataataagaggctggatatttggtactactttagattcgaagacccagtccctacttattgttaataacgctactaatgttgttattaaagtctgtga
atttcaattctgtaatgatccattcttgggtgtttattaccacaagaacaacaagagttggatggaaagtgagttcagagtttattctagtgcgaat
aattgcactttcgaatatgtctctcagcctttccttatggaccttgaaggtaaacagggtaatttcaagaatcttagggaatttgtgtttaagaatat
tgatggttatttcaagatatattctaagcacacgcctattaatttagtgcgtgatctccctcagggtttctcggctttagaaccattggtagatttgc
caataggtattaacatcactaggtttcaaactttacttgctttacatagaagttatttgactcctggtgattcttcttcaggttggacagctggtgct
gcagcttattatgtgggttatcttcaacctaggactttcctattgaaatataatgagaatggaaccattacagatgctgtagactgtgcacttgac
cctctctcagaaacaaagtgtacgttgaaatccttcactgtagagaaaggaatctatcaaacttctaactttagagtccaaccaacagaatctat
tgttagatttcctaatattacaaacttgtgccctttcggtgaagtatttaacgccaccagatttgcatctgtttatgcttggaacaggaagagaatc
agcaactgtgttgctgattattctgtcctatataattccgcatcattctccacatttaagtgttatggagtgtctcctactaaattaaatgatctctgct
ttactaatgtctatgcagattcatttgtaattagaggtgatgaagtcagacaaatcgctccagggcaaactggaaagattgctgattataattata
aattaccagatgactttacaggctgcgttatagcttggaattctaacaatcttgattctaaggttggtggtaattataattacctgtatagattgttta
ggaagtctaatctcaaacctttcgagagagatatttcaactgaaatctatcaggccggtagcacaccttgtaatggtgttgaaggatttaattgtt
actttcctttacaatcatatggtttccaacccactaatggtgttggttaccaaccatacagagtagtagtactttcatttgaacttctacatgcacca
gcaactgtttgtggacctaagaagtctactaatttggttaagaacaaatgtgtcaatttcaacttcaatggttaacaggcacaggtgttcttact
gagtctaacaagaagtttctgcctttccaacaatttggcagagacattgctgacactactgatgctgtccgtgatccacagacacttgagattct
tgacattacaccatgttcatttggtggtgtcagtgttataacaccaggaacaaatacttctaaccaggttgctgttctttatcaggatgttaactgc
acagaagtccctgttgctattcatgcagatcaacttactcctacttggcgtgtgtttattctacaggttctaatgtatttcaaacacgtgcaggctgttt
aataggagctgaacatgtcaacaactcatatgagtgtgacataccattggtgcaggtatatgcgctagttatcagactcagactaattctcct
cggcgggcacgtagtgtagctagtcaatccatcattgcctacactatgtcacttggtgcagagaattcagttgcttactctaataactctattgc
catacccacaaactttactattagtgttaccacagaaattctaccagtgtctatgaccaagacatcagtagattgtacaatgtacatttgtggtga
ttcaactgaatgcagcaatcattgttgcaatatggcagtttctgtacacaattaaaccgtgctttaactggaatagctgttgaacaagacaaga
acacccaagaagtatttgcacaagtcaaacaaatttacaagacaccaccaattaaagatttcggtggatttaatttctcacaaatattaccagat
ccatctaaaccaagcaagaggtcatttattgaagatctactattcaacaaagtgacacttgcagatgctggcttcatcaaacaatatggtgattg
ccttggtgatattgctgctagagacctcatttgtgtcacagaagtttaacggccttactgtattgccacctttgctcacagatgaaatgattgctca
atacacttctgcactgttagcgggtacaatcacttctggttggacctttggtgcaggtgctgcattacaaataccatttgctatgcaaatggctta
taggtttaatggtattggagttacacagaatgttctctatgagaaccagaaattgattgccaaccaatttaatagtgctattggcaagattcaaga
ctcactttcttccacagcaagtgcacttggtaaacttcaagatgtggtcaaccagaatgcacaagctttaaacacgcttgttaaacaacttagct
ccaactttggtgcaatttcaagtgtattaaatgatatcctttcacgtcttgacaaagttgaggctgaagtgcaaattgataggttgatcacaggca
gacttcaaagtttgcagacatatgtgactcaacaattaattagagctgcagaaatcagagcttctgctaatcttgctgctactaagatgtcagag
tgtgtacttggacaatctaagagagttgatttctgtggaaagggctatcatcttatgtccttccctcagtcagcacctcatggtgtagtcttcttgc
atgtgacttatgtccctgcacaagagaagaacttcacaactgctcctgccatttgtcatgatggtaaagcacactttcctcgtgaaggtgtcttt
gtttcaaatggcacacactggtttgtaacacaaaggaatttctatgaaccacaaatcattactacagacaacacatttgtgtctggtaactgtga
tgttgtaataggaattgtcaacaacacagtttatgatcctttgcaacctgaattagactcattcaaggaggagttagataaatatttcaagaatca
tacatcaccagatgttgatttaggtgacatctctggcattaatgcttcagttgtaaacattcagaaagaaattgaccgcctcaatgaggttgcca
agaatttaaatgaatctctcatcgatctccaagaacttggaaagtatgagcagtatatcaaatggccatggtacatttggctaggtttcatagct
ggcttgattgccatagtaatggtgacaattatgctttgctgtatgaccagttgctgtagttgtctcaagggctgttgttcttgtggatcctgctgca
aatttgatgaagacgactctgagccagtgctcaaaggagtcaaattacattacacataa

Fig. 63

MFVFLVLLPLVSSQCVNLTTRTQLPPAYTNSFTRGVYYPDKVFRSSVLHSTQDLFLPFFS
NVTWFHAIHVSGTNGTKRFDNPVLPFNDGVYFASTEKSNIIRGWIFGTTLDSKTQSLLIV
NNATNVVIKVCEFQFCNDPFLGVYYHKNNKSWMESEFRVYSSANNCTFEYVSQPFLMD
LEGKQGNFKNLREFVFKNIDGYFKIYSKHTPINLVRDLPQGFSALEPLVDLPIGINITRFQ
TLLALHRSYLTPGDSSSGWTAGAAAYYVGYLQPRTFLLKYNENGTITDAVDCALDPLS
ETKCTLKSFTVEKGIYQTSNFRVQPTESIVRFPNITNLCPFGEVFNATRFASVYAWNRKRI
SNCVADYSVLYNSASFSTFKCYGVSPTKLNDLCFTNVYADSFVIRGDEVRQIAPGQTGK
IADYNYKLPDDFTGCVIAWNSNNLDSKVGGNYNYLYRLFRKSNLKPFERDISTEIYQAG
STPCNGVEGFNCYFPLQSYGFQPTNGVGYQPYRVVVLSFELLHAPATVCGPKKSTNLV
KNKCVNFNFNGLTGTGVLTESNKKFLPFQQFGRDIADTTDAVRDPQTLEILDITPCSFGG
VSVITPGTNTSNQVAVLYQDVNCTEVPVAIHADQLTPTWRVYSTGSNVFQTRAGCLIGA
EHVNNSYECDIPIGAGICASYQTQTNSPRRARSVASQSIIAYTMSLGAENSVAYSNNSIAI
PTNFTISVTTEILPVSMTKTSVDCTMYICGDSTECSNLLLQYGSFCTQLNRALTGIAVEQD
KNTQEVFAQVKQIYKTPPIKDFGGFNFSQILPDPSKPSKRSFIEDLLFNKVTLADAGFIKQ
YGDCLGDIAARDLICAQKFNGLTVLPPLLTDEMIAQYTSALLAGTITSGWTFGAGAALQ
IPFAMQMAYRFNGIGVTQNVLYENQKLIANQFNSAIGKIQDSLSSTASALGKLQDVVNQ
NAQALNTLVKQLSSNFGAISSVLNDILSRLDKVEAEVQIDRLITGRLQSLQTYVTQQLIR
AAEIRASANLAATKMSECVLGQSKRVDFCGKGYHLMSFPQSAPHGVVFLHVTYVPAQE
KNFTTAPAICHDGKAHFPREGVFVSNGTHWFVTQRNFYEPQIITTDNTFVSGNCDVVIGI
VNNTVYDPLQPELDSFKEELDKYFKNHTSPDVDLGDISGINASVVNIQKEIDRLNEVAK
NLNESLIDLQELGKYEQYIKWPWYIWLGFIAGLIAIVMVTIMLCCMTSCCSCLKGCCSC
GSCCKFDEDDSEPVLKGVKLHYT

Fig. 64 atgtctgataatggaccccaaaatcagcgaaatgcaccccgcattacgtttggtggaccctcagattcaactggcagtaaccagaatggag
aacgcagtggggcgcgatcaaaacaacgtcggccccaaggtttacccaataatactgcgtcttggttcaccgctctcactcaacatggcaa
ggaagaccttaaattccctcgaggacaaggcgttccaattaacaccaatagcagtccagatgaccaaattggctactaccgaagagctacc
agacgaattcgtggtggtgacggtaaaatgaaagatctcagtccaagatggtatttctactacctaggaactgggccagaagctggacttcc
ctatggtgctaacaaagacggcatcatatgggttgcaactgagggagccttgaatacaccaaaagatcacattggcacccgcaatcctgct
aacaatgctgcaatcgtgctacaacttcctcaaggaacaacattgccaaaaggcttctacgcagaagggagcagaggcggcagtcaagc
ctcttctcgttcctcatcacgtagtcgcaacagttcaagaaattcaactccaggcagcagtaggggaacttctcctgctagaatggctggcaa
tggcggtgatgctgctcttgctttgctgctgcttgacagattgaaccagcttgagagcaaaatgtctggtaaaggccaacaacaacaaggcc
aaactgtcactaagaaatctgctgctgaggcttctaagaagcctcggcaaaaacgtactgccactaaagcatacaatgtaacacaagctttc
ggcagacgtggtccagaacaaacccaaggaaattttggggaccaggaactaatcagacaaggaactgattacaaacattggccgcaaatt
gcacaatttgcccccagcgcttcagcgttcttcggaatgtcgcgcattggcatggaagtcacaccttcgggaacgtggttgacctacacagg
tgccatcaaattggatgacaaagatccaaatttcaaagatcaagtcattttgctgaataagcatattgacgcatacaaaacattcccaccaaca
gagcctaaaaaggacaaaaagaagaaggctgatgaaactcaagccttaccgcagagacagaagaaacagcaaactgtgactcttcttcct
gctgcagatttggatgatttctccaaacaattgcaacaatccatgagcagtgctgactcaactcaggcctaa

Fig. 65

MSDNGPQNQRNAPRITFGGPSDSTGSNQNGERSGARSKQRRPQGLPNNTASWFTALTQ
HGKEDLKFPRGQGVPINTNSSPDDQIGYYRRATRRIRGGDGKMKDLSPRWYFYYLGTG
PEAGLPYGANKDGIIWVATEGALNTPKDHIGTRNPANNAAIVLQLPQGTTLPKGFYAEG
SRGGSQASSRSSSRSRNSSRNSTPGSSRGTSPARMAGNGGDAALALLLLDRLNQLESKM
SGKGQQQQGQTVTKKSAAEASKKPRQKRTATKAYNVTQAFGRRGPEQTQGNFGDQEL
IRQGTDYKHWPQIAQFAPSASAFFGMSRIGMEVTPSGTWLTYTGAIKLDDKDPNFKDQ
VILLNKHIDAYKTFPPTEPKKDKKKKADETQALPQRQKKQQTVTLLPAADLDDFSKQL
QQSMSSADSTQA

Fig. 66 atgtctgataacggaccacagaatcagcgaaacgcaccacgcattacgtttggtggaccctcagattcaactggcagtaaccagaatggag
aacgcagtggagcgcgatctaaacaacgtcggcctcaaggtttacccaataatactgcgtcttggttcaccgctctcactcaacatggcaag
gaagaccttaaattccctcgaggacaaggcgttccaattaacaccaatagcagtccagatgaccaaattggctactaccgaagagctacca
gacgaattcgtggtggtgacggtaagatgaaagatctcagtccaagatggtatttctactacctaggaactgggccagaagctggacttccc
tatggtgctaacaaagacggcatcatatgggttgcaactgagggagccttgaatacacctaaagatcacattggcacccgcaatcctgctaa
caatgctgcaatcgtgctacaacttcctcaaggaacaacattgcctaaaggcttctacgcagaagggagcagaggcggcagtcaagcctct
tctcgttcctcatcacgtagtcgcaacagttcaagaaattcaactccaggcagcagtagaggaacttctcctgctagaatggctggcaatggc
ggtgatgctgctcttgctttgctgctgcttgacagattgaaccagcttgagagcaagatgtctggtaaaggccaacaacaacaaggccaaac
tgtcactaagaaatctgctgctgaggcttctaagaagcctcggcagaaacgtactgccactaaagcatacaatgtaacacaagctttcggca
gacgtggtccagaacaaacccaaggaaactttggagaccaggaactaatcagacaaggaactgattacaaacattggccgcaaattgcac
aatttgctcccagcgcttcagcgttcttcggaatgtcgcgcattggcatggaagtcacaccttcgggaacgtggttgacctacacaggtgcc
atcaaattggatgacaaagatccaaatttcaaagatcaagtcatattgctgaataagcatattgacgcatacaagacattcccaccaacagag
cctaagaaggacaagaagaagaaggctgatgaaactcaagccttaccgcagagacagaagaaacagcaaactgtgactcttcttcctgct
gcagatttggatgatttctccaaacaattgcaacaatccatgagcagtgctgactcaactcaggcctaa

Fig. 67

MSDNGPQNQRNAPRITFGGPSDSTGSNQNGERSGARSKQRRPQGLPNNTASWFTALTQ
HGKEDLKFPRGQGVPINTNSSPDDQIGYYRRATRRIRGGDGKMKDLSPRWYFYYLGTG
PEAGLPYGANKDGIIWVATEGALNTPKDHIGTRNPANNAAIVLQLPQGTTLPKGFYAEG
SRGGSQASSRSSSRSRNSSRNSTPGSSRGTSPARMAGNGGDAALALLLLDRLNQLESKM
SGKGQQQQGQTVTKKSAAEASKKPRQKRTATKAYNVTQAFGRRGPEQTQGNFGDQEL
IRQGTDYKHWPQIAQFAPSASAFFGMSRIGMEVTPSGTWLTYTGAIKLDDKDPNFKDQ
VILLNKHIDAYKTFPPTEPKKDKKKKADETQALPQRQKKQQTVTLLPAADLDDFSKQL
QQSMSSADSTQA

Fig. 68 atgtttgtctttcttgtcttattgccactagtctctagtcagtgtgttaatcttacaaccagaactcaattaccacctgcatacactaattctttcacac
gtggtgtttattaccctgacaaagtattcagatcctcagtattacattcaactcaggacttgttcttacctttcttctccaatgttacttggttccatgc
tatacatgtctctgggaccaatggtactaagaggtttgataaccctgtcctaccatttaatgatggtgtttatttcgcttccactgagaagtctaac
ataataagaggctggatatttggtactactttagattcgaagacccagtccctacttattgttaataacgctactaatgttgttattaaagtctgtga
atttcaattctgtaatgatccattcttgggtgtttattaccacaagaacaacaagagttggatggaaagtgagttcagagtttattctagtgcgaat
aattgcactttcgaatatgtctctcagcctttccttatggaccttgaaggtaaacagggtaatttcaagaatcttagggaatttgtgtttaagaatat
tgatggttatttcaagatatattctaagcacacgcctattaatttagtgcgtgatctccctcagggtttctcggctttagaaccattggtagatttgc
caataggtattaacatcactaggtttcaaacttttacttgctttacatagaagttatttgactcctggtgattcttcttcaggttggacagctggtgct
gcagcttattatgtgggttatcttcaacctaggactttcctattgaaatataatgagaatggaaccattacagatgctgtagactgtgcacttgac
cctctctcagaaacaaagtgtacgttgaaatccttcactgtagagaaaggaatctatcaaacttctaactttagagtccaaccaacagaatctat
tgttagatttcctaatattacaaacttgtgcccctttcggtgaagtatttaacgccaccagatttgcatctgtttatgcttggaacaggaagagaatc
agcaactgtgttgctgattattctgtcctatataattccgcatcattctccacatttaagtgttatggagtgtctcctactaaattaaatgatctctgct
ttactaatgtctatgcagattcatttgtaattagaggtgatgaagtcagacaaatcgctccagggcaaactggaaagattgctgattataattata
aattaccagatgactttacaggctgcgttatagcttggaattctaacaatcttgattctaaggttggtggtaattataattacctgtatagattgttta
ggaagtctaatctcaaacctttcgagagagatatttcaactgaaatctatcaggccggtagcacaccttgtaatggtgttgaaggatttaattgtt
actttcctttacaatcatatggtttccaacccactaatggtgttggttaccaaccatacagagtagtagtactttcatttgaacttctacatgcacca
gcaactgtttgtggacctaagaagtctactaatttggttaagaacaaatgtgtcaatttcaacttcaatggttaacaggcacaggtgttcttact
gagtctaacaagaagtttctgcctttccaacaatttggcagagacattgctgacactactgatgctgtccgtgatccacagacacttgagattct
tgacattacaccatgttcatttggtggtgtcagtgttataacaccaggaacaaatacttctaaccaggttgctgttctttatcaggatgttaactgc
acagaagtccctgttgctattcatgcagatcaacttactcctacttggcgtgtgttattctacaggttctaatgtatttcaaacacgtgcaggctgttt
aataggagctgaacatgtcaacaactcatatgagtgtgacatacccattggtgcaggtatatgcgctagttatcagactcagactaattctcct
cggcgggcacgtagtgtagctagtcaatccatcattgcctacactatgtcacttggtgcagagaattcagttgcttactctaataactctattgc
catacccacaaactttactattagtgttaccacagaaaattctaccagtgtctatgaccaagacatcagtagattgtacaatgtacatttgtggtga
ttcaactgaatgcagcaatctattgttgcaatatggcagtttctgtacacaattaaaccgtgctttaactggaatagctgttgaacaagacaaga
acacccaagaagtatttgcacaagtcaaacaaatttacaagacaccaccaattaaagatttcggtggatttaatttctcacaaatattaccagat
ccatctaaaccaagcaagaggtcatttattgaagatctactattcaacaaagtgacacttgcagatgctggcttcatcaaacaatatggtgattg
ccttggtgatattgctgctagagacctcatttgtgtcacagaagtttaacggccttactgtattgccaccttgctcacagatgaaatgattgctca
atacacttctgcactgttagcgggtacaatcacttctggttggacctttggtgcaggtgctgcattacaaataccatttgctatgcaaatggctta
taggtttaatggtattggagttacacagaatgttctctatgagaaccagaaattgattgccaaccaatttaatagtgctattggcaagattcaaga
ctcactttcttccacagcaagtgcacttggtaaacttcaagatgtggtcaaccagaatgcacaagctttaaacacgcttgttaaacaacttagct
ccaactttggtgcaatttcaagtgtattaaatgatatcctttcacgtcttgacccacctgaggctgaagtgcaaattgataggttgatcacaggc
agacttcaaagtttgcagacatatgtgactcaacaattaattagagctgcagaaatcagagcttctgctaatcttgctgctactaagatgtcaga
gtgtgtacttggacaatcaagagagttgatttctgtggaaagggctatcatcttatgtccttccctcagtcagcacctcatggtgtagtcttcttg
catgtgacttatgtccctgcacaagagaagaacttcacaactgctcctgccatttgtcatgatggtaaagcacactttcctcgtgaaggtgtctt
tgtttcaaatggcacacactggtttgtaacacaaaggaatttctatgaaccacaaatcattactacagacaacacatttgtgtctggtaactgtg
atgttgtaataggaattgtcaacaacacagtttatgatcctttgcaacctgaattagactcattcaaggaggagttagataaatatttcaagaatc
atacatcaccagatgttgatttaggtgacatctctggcattaatgcttcagttgtaaacattcagaaagaaattgaccgcctcaatgaggttgcc
aagaatttaaatgaatctctcatcgatctccaagaacttggaaagtatgagcagtatatcaaatggccatggtacatttggctaggtttcatagc
tggcttgattgccatagtaatggtgacaattatgctttgctgtatgaccagttgctgtagttgtctcaagggctgttgttcttgtggatcctgctgc
aaatttgatgaagacgactctgagccagtgctcaaaggagtcaaattacattacacataa

Fig. 69

MFVFLVLLPLVSSQCVNLTTRTQLPPAYTNSFTRGVYYPDKVFRSSVLHSTQDLFLPFFS
NVTWFHAIHVSGTNGTKRFDNPVLPFNDGVYFASTEKSNIIRGWIFGTTLDSKTQSLLIV
NNATNVVIKVCEFQFCNDPFLGVYYHKNNKSWMESEFRVYSSANNCTFEYVSQPFLMD
LEGKQGNFKNLREFVFKNIDGYFKIYSKHTPINLVRDLPQGFSALEPLVDLPIGINITRFQ
TLLALHRSYLTPGDSSSGWTAGAAAYYVGYLQPRTFLLKYNENGTITDAVDCALDPLS
ETKCTLKSFTVEKGIYQTSNFRVQPTESIVRFPNITNLCPFGEVFNATRFASVYAWNRKRI
SNCVADYSVLYNSASFSTFKCYGVSPTKLNDLCFTNVYADSFVIRGDEVRQIAPGQTGK
IADYNYKLPDDFTGCVIAWNSNNLDSKVGGNYNYLYRLFRKSNLKPFERDISTEIYQAG
STPCNGVEGFNCYFPLQSYGFQPTNGVGYQPYRVVVLSFELLHAPATVCGPKKSTNLV
KNKCVNFNFNGLTGTGVLTESNKKFLPFQQFGRDIADTTDAVRDPQTLEILDITPCSFGG
VSVITPGTNTSNQVAVLYQDVNCTEVPVAIHADQLTPTWRVYSTGSNVFQTRAGCLIGA
EHVNNSYECDIPIGAGICASYQTQTNSPRRARSVASQSIIAYTMSLGAENSVAYSNNSIAI
PTNFTISVTTEILPVSMTKTSVDCTMYICGDSTECSNLLLQYGSFCTQLNRALTGIAVEQD
KNTQEVFAQVKQIYKTPPIKDFGGFNFSQILPDPSKPSKRSFIEDLLFNKVTLADAGFIKQ
YGDCLGDIAARDLICAQKFNGLTVLPPLLTDEMIAQYTSALLAGTITSGWTFGAGAALQ
IPFAMQMAYRFNGIGVTQNVLYENQKLIANQFNSAIGKIQDSLSSTASALGKLQDVVNQ
NAQALNTLVKQLSSNFGAISSVLNDILSRLDPPEAEVQIDRLITGRLQSLQTYVTQQLIRA
AEIRASANLAATKMSECVLGQSKRVDFCGKGYHLMSFPQSAPHGVVFLHVTYVPAQEK
NFTTAPAICHDGKAHFPREGVFVSNGTHWFVTQRNFYEPQIITTDNTFVSGNCDVVIGIV
NNTVYDPLQPELDSFKEELDKYFKNHTSPDVDLGDISGINASVVNIQKEIDRLNEVAKNL
NESLIDLQELGKYEQYIKWPWYIWLGFIAGLIAIVMVTIMLCCMTSCCSCLKGCCSCGSC
CKFDEDDSEPVLKGVKLHYT

Fig. 70 atgtttgtctttcttgtcttattgccactagtctctagtcagtgtgttaatcttacaaccagaactcaattaccacctgcatacactaattctttcacac
gtggtgtttattaccctgacaaagtattcagatcctcagtattacattcaactcaggacttgttcttacctttcttctccaatgttacttggttccatgc
tatacatgtctctgggaccaatggtactaagagggtttgataaccctgtcctaccatttaatgatggtgtttatttcgcttccactgagaagtctaac
ataataagaggctggatatttggtactactttagattcgaagacccagtccctacttattgttaataacgctactaatgttgttattaaagtctgtga
atttcaattctgtaatgatccattcttgggtgtttattaccacaagaacaacaagagttggatggaaagtgagttcagagtttattctagtgcgaat
aattgcacttcgaatatgtctctcagcctttccttatggaccttgaaggtaaacagggtaatttcaagaatcttagggaatttgtgtttaagaatat
tgatggttatttcaagatatattctaagcacacgcctattaatttagtgcgtgatctccctcagggtttctcggctttagaaccattggtagatttgc
caataggtattaacatcactaggtttcaaactttacttgctttacatagaagttatttgactcctggtgattcttcttcaggttggacagctggtgct
gcagcttattatgtgggttatcttcaacctaggactttcctattgaaatataatgagaatggaaccattacagatgctgtagactgtgcacttgac
cctctctcagaaacaaagtgtacgttgaaatccttcactgtagagaaaggaatctatcaaacttctaactttagagtccaaccaacagaatctat
tgttagatttcctaatattacaaacttgtgcccttcggtgaagtatttaacgccaccagatttgcatctgtttatgcttggaacaggaagagaatc
agcaactgtgttgctgattattctgtcctatataattccgcatcattctccacatttaagtgttatggagtgtctcctactaaattaaatgatctctgct
ttactaatgtctatgcagattcatttgtaattagaggtgatgaagtcagacaaatcgctccagggcaaactggaaagattgctgattataattata
aattaccagatgactttacaggctgcgttatagcttggaattctaacaatcttgattctaaggttggtggtaattataattacctgtatagattgttta
ggaagtctaatctcaaacctttcgagagagatatttcaactgaaatctatcaggccggtagcacaccttgtaatggtgttgaaggatttaattgtt
actttcctttacaatcatatggtttccaacccactaatggtgttggttaccaaccatacagagtagtagtactttcatttgaacttctacatgcacca
gcaactgtttgtggacctaagaagtctactaatttggttaagaacaaatgtgtcaatttcaacttcaatggttaacaggcacaggtgttcttact
gagtctaacaagaagtttctgcctttccaacaatttggcagagacattgctgacactactgatgctgtccgtgatccacagacacttgagattct
tgacattacaccatgttcatttggtggtgtcagtgttataacaccaggaacaaatacttctaaccaggttgctgttctttatcaggatgttaactgc
acagaagtccctgttgctattcatgcagatcaacttactcctacttggcgtgtgtttattctacaggttctaatgtatttcaaacacgtgcaggctgttt
aataggagctgaacatgtcaacaactcatatgagtgtgacatacccattggtgcaggtatatgcgctagttatcagactcagactaattctcct
ggatcagcttcaagtgtagctagtcaatccatcattgcctacactatgtcacttggtgcagagaattcagttgcttactctaataactctattgcc
atacccacaaactttactattagtgttaccacagaaattctaccagtgtctatgaccaagacatcagtagattgtacaatgtacatttgtggtgatt
caactgaatgcagcaatctattgttgcaatatggcagttctgtacacaattaaaccgtgctttaactggaatagctgttgaacaagacaagaa
cacccaagaagtatttgcacaagtcaaacaaatttacaagacaccaccaattaaagattcggtggatttaatttctcacaaatattaccagatc
catctaaaccaagcaagaggtcatttattgaagatctactattcaacaaagtgacacttgcagatgctggcttcatcaaacaatatggtgattgc
cttggtgatattgctgctagagacctcatttgtgcacagaagtttaacggccttactgtattgccacctttgctcacagatgaaatgattgctcaa
tacacttctgcactgttagcgggtacaatcacttctggttggacctttggtgcaggtgctgcattacaaataccatttgctatgcaaatggcttat
aggtttaatggtattggagttacacagaatgttctctatgagaaccagaaattgattgccaaccaatttaatagtgctattggcaagattcaaga
ctcactttcttccacagcaagtgcacttggtaaacttcaagatgtggtcaaccagaatgcacaagctttaaacacgcttgttaaacaacttagct
ccaactttggtgcaatttcaagtgtattaaatgatatcctttcacgtcttgacccacctgaggctgaagtgcaaattgataggttgatcacaggc
agacttcaaagtttgcagacatatgtgactcaacaattaattagagctgcagaaatcagagcttctgctaatcttgctgctactaagatgtcaga
gtgtgtacttggacaatcaagagagttgatttctgtggaaagggctatcatcttatgtccttccctcagtcagcacctcatggtgtagtcttcttg
catgtgacttatgtccctgcacaagagaagaacttcacaactgctcctgccatttgtcatgatggtaaagcacactttcctcgtgaaggtgtctt
tgtttcaaatggcacacactggtttgtaacacaaaggaatttctatgaaccacaaatcattactacagacaacacatttgtgtctggtaactgtg
atgttgtaataggaattgtcaacaacacagtttatgatcctttgcaacctgaattagactcattcaaggaggagttagataaatatttcaagaatc
atacatcaccagatgttgatttaggtgacatctctggcattaatgcttcagttgtaaacattcagaaagaaattgaccgcctcaatgaggttgcc
aagaatttaaatgaatctctcatcgatctccaagaacttggaaagtatgagcagtatatcaaatggccatggtacatttggctaggtttcatagc
tggcttgattgccatagtaatggtgacaattatgctttgctgtatgaccagttgctgtagttgtctcaagggctgttgttcttgtggatcctgctgc
aaatttgatgaagacgactctgagccagtgctcaaaggagtcaaattacattacacataa

Fig. 71

MFVFLVLLPLVSSQCVNLTTRTQLPPAYTNSFTRGVYYPDKVFRSSVLHSTQDLFLPFFS
NVTWFHAIHVSGTNGTKRFDNPVLPFNDGVYFASTEKSNIIRGWIFGTTLDSKTQSLLIV
NNATNVVIKVCEFQFCNDPFLGVYYHKNNKSWMESEFRVYSSANNCTFEYVSQPFLMD
LEGKQGNFKNLREFVFKNIDGYFKIYSKHTPINLVRDLPQGFSALEPLVDLPIGINITRFQ
TLLALHRSYLTPGDSSSGWTAGAAAYYVGYLQPRTFLLKYNENGTITDAVDCALDPLS
ETKCTLKSFTVEKGIYQTSNFRVQPTESIVRFPNITNLCPFGEVFNATRFASVYAWNRKRI
SNCVADYSVLYNSASFSTFKCYGVSPTKLNDLCFTNVYADSFVIRGDEVRQIAPGQTGK
IADYNYKLPDDFTGCVIAWNSNNLDSKVGGNYNYLYRLFRKSNLKPFERDISTEIYQAG
STPCNGVEGFNCYFPLQSYGFQPTNGVGYQPYRVVVLSFELLHAPATVCGPKKSTNLV
KNKCVNFNFNGLTGTGVLTESNKKFLPFQQFGRDIADTTDAVRDPQTLEILDITPCSFGG
VSVITPGTNTSNQVAVLYQDVNCTEVPVAIHADQLTPTWRVYSTGSNVFQTRAGCLIGA
EHVNNSYECDIPIGAGICASYQTQTNSPGSASSVASQSIIAYTMSLGAENSVAYSNNSIAI
PTNFTISVTTEILPVSMTKTSVDCTMYICGDSTECSNLLLQYGSFCTQLNRALTGIAVEQD
KNTQEVFAQVKQIYKTPPIKDFGGFNFSQILPDPSKPSKRSFIEDLLFNKVTLADAGFIKQ
YGDCLGDIAARDLICAQKFNGLTVLPPLLTDEMIAQYTSALLAGTITSGWTFGAGAALQ
IPFAMQMAYRFNGIGVTQNVLYENQKLIANQFNSAIGKIQDSLSSTASALGKLQDVVNQ
NAQALNTLVKQLSSNFGAISSVLNDILSRLDPPEAEVQIDRLITGRLQSLQTYVTQQLIRA
AEIRASANLAATKMSECVLGQSKRVDFCGKGYHLMSFPQSAPHGVVFLHVTYVPAQEK
NFTTAPAICHDGKAHFPREGVFVSNGTHWFVTQRNFYEPQIITTDNTFVSGNCDVVIGIV
NNTVYDPLQPELDSFKEELDKYFKNHTSPDVDLGDISGINASVVNIQKEIDRLNEVAKNL
NESLIDLQELGKYEQYIKWPWYIWLGFIAGLIAIVMVTIMLCCMTSCCSCLKGCCSCGSC
CKFDEDDSEPVLKGVKLHYT

Fig. 72 atgtttgtctttcttgtcttattgccactagtctctagtcagtgtgttaatcttacaaccagaactcaattaccacctgcatacactaattctttcacac
gtggtgtttattaccctgacaaagtattcagatcctcagtattacattcaactcaggacttgttcttacctttcttctccaatgttacttggttccatgc
tatacatgtctctgggaccaatggtactaagaggtttgataaccctgtcctaccatttaatgatggtgtttatttcgcttccactgagaagtctaac
ataataagagggctggatatttggtactactttagattcgaagacccagtccctacttattgttaataacgctactaatgttgttattaaagtctgtga
atttcaattctgtaatgatccattcttgggtgtttattaccacaagaacaacaagagttggatggaaagtgagttcagagtttattctagtgcgaat
aattgcactttcgaatatgtctctcagcctttccttatggaccttgaaggtaaacagggtaatttcaagaatcttagggaatttgtgtttaagaatat
tgatggttatttcaagatatattctaagcacacgcctattaatttagtgcgtgatctccctcagggtttctcggctttagaaccattggtagatttgc
caataggtattaacatcactaggtttcaaactttacttgctttacatagaagttatttgactcctggtgattcttcttcaggttggacagctggtgct
gcagcttattatgtgggttatcttcaacctaggactttcctattgaaatataatgagaatggaaccattacagatgctgtagactgtgcacttgac
cctctctcagaaacaaagtgtacgttgaaatccttcactgtagagaaaggaatctatcaaacttctaactttagagtccaaccaacagaatctat
tgttagatttcctaatattacaaacttgtgccctttcggtgaagtatttaacgccaccagatttgcatctgtttatgcttggaacaggaagagaatc
agcaactgtgttgctgattattctgtcctatataattccgcatcattctccacatttaagtgttatggagtgtctcctactaaattaaatgatctctgct
ttactaatgtctatgcagattcatttgtaattagaggtgatgaagtcagacaaatcgctccagggcaaactggaaagattgctgattataattata
aattaccagatgactttacaggctgcgttatagcttggaattctaacaatcttgattctaaggttggtggtaattataattacctgtatagattgttta
ggaagtctaatctcaaacctttcgagagagatatttcaactgaaatctatcaggccggtagcacacacttgtaatggtgttgaaggatttaattgtt
actttcctttacaatcatatggtttccaacccactaatggtgttggttaccaaccatacagagtagtagtactttcatttgaacttctacatgcacca
gcaactgtttgtggacctaagaagtctactaatttggttaagaacaaatgtgtcaatttcaacttcaatggttaacaggcacaggtgttcttact
gagtctaacaagaagtttctgcctttccaacaatttggcagagacattgctgacactactgatgctgtccgtgatccacagacacttgagattct
tgacattacaccatgttcatttggtggtgtcagtgttataacaccaggaacaaatacttctaaccaggttgctgttctttatcaggatgttaactgc
acagaagtccctgttgctattcatgcagatcaacttactcctacttggcgtgtgtttattctacaggttctaatgtatttcaaacacgtgcaggctgttt
aataggagctgaacatgtcaacaactcatatgagtgtgacatacccattggtgcaggtatatgcgctagttatcagactcagactaattctcct
ggatcagcttcaagtgtagctagtcaatccatcattgcctacactatgtcacttggtgcagagaattcagttgcttactctaataactctattgcc
atacccacaaactttactattagtgttaccacagaaattctaccagtgtctatgaccaagacatcagtagattgtacaatgtacatttgtggtgatt
caactgaatgcagcaatctattgttgcaatatggcagtttctgtacacaattaaaccgtgctttaactggaatagctgttgaacaagacaagaa
cacccaagaagtatttgcacaagtcaaacaaatttacaagacaccaccaattaaagattcggtggatttaatttctcacaaatattaccagatc
catctaaaccaagcaagaggtcatttattgaagatctactattcaacaaagtgacacttgcagatgctggcttcatcaaacaatatggtgattgc
cttggtgatattgctgctagagacctcatttgtgcacagaagtttaacggccttactgtattgccacctttgctcacagatgaaatgattgctcaa
tacacttctgcactgttagcgggtacaatcacttctggttggacctttggtgcaggtgctgcattacaaataccatttgctatgcaaatggcttat
aggtttaatggtattggagttacacagaatgttctctatgagaaccagaaattgattgccaaccaatttaatagtgctattggcaagattcaaga
ctcactttcttccacagcaagtgcacttggtaaacttcaagatgtggtcaaccagaatgcacaagctttaaacacgcttgttaaacaacttagct
ccaactttggtgcaatttcaagtgtattaaatgatatcctttcacgtcttgacccacctgaggctgaagtgcaaattgataggttgatcacaggc
agacttcaaagtttgcagacatatgtgactcaacaattaattagagctgcagaaatcagagcttctgctaatcttgctgctactaagatgtcaga
gtgtgtacttggacaatctaagagagttgatttctgtggaaagggctatcatcttatgtccttccctcagtcagcacctcatggtgtagtcttcttg
catgtgacttatgtccctgcacaagagaagaacttcacaactgctcctgccatttgtcatgatggtaaagcacactttcctcgtgaaggtgtctt
tgtttcaaatggcacacactggtttgtaacacaaaggaatttctatgaaccacaaatcattactacagacaacacatttgtgtctggtaactgtg
atgttgtaataggaattgtcaacaacacagtttatgatcctttgcaacctgaattagactcattcaaggaggagttagataaatatttcaagaatc
atacatcaccagatgttgatttaggtgacatctctggcattaatgcttcagttgtaaacattcagaaagaaattgaccgcctcaatgaggttgcc
aagaatttaaatgaatctctcatcgatctccaagaacttggaaagtatgagcagtatatcaaatggccatggtacatttggctaggtttcatagc
tggcttgattgccatagtaatggtgacaattatgctttgctgtatgaccagttgctgtagttgtctcaagggctgttgttcttgtggatcctgctgct
aa

Fig. 73

MFVFLVLLPLVSSQCVNLTTRTQLPPAYTNSFTRGVYYPDKVFRSSVLHSTQDLFLPFFS
NVTWFHAIHVSGTNGTKRFDNPVLPFNDGVYFASTEKSNIIRGWIFGTTLDSKTQSLLIV
NNATNVVIKVCEFQFCNDPFLGVYYHKNNKSWMESEFRVYSSANNCTFEYVSQPFLMD
LEGKQGNFKNLREFVFKNIDGYFKIYSKHTPINLVRDLPQGFSALEPLVDLPIGINITRFQ
TLLALHRSYLTPGDSSSGWTAGAAAYYVGYLQPRTFLLKYNENGTITDAVDCALDPLS
ETKCTLKSFTVEKGIYQTSNFRVQPTESIVRFPNITNLCPFGEVFNATRFASVYAWNRKRI
SNCVADYSVLYNSASFSTFKCYGVSPTKLNDLCFTNVYADSFVIRGDEVRQIAPGQTGK
IADYNYKLPDDFTGCVIAWNSNNLDSKVGGNYNYLYRLFRKSNLKPFERDISTEIYQAG
STPCNGVEGFNCYFPLQSYGFQPTNGVGYQPYRVVVLSFELLHAPATVCGPKKSTNLV
KNKCVNFNFNGLTGTGVLTESNKKFLPFQQFGRDIADTTDAVRDPQTLEILDITPCSFGG
VSVITPGTNTSNQVAVLYQDVNCTEVPVAIHADQLTPTWRVYSTGSNVFQTRAGCLIGA
EHVNNSYECDIPIGAGICASYQTQTNSPGSASSVASQSIIAYTMSLGAENSVAYSNNSIAI
PTNFTISVTTEILPVSMTKTSVDCTMYICGDSTECSNLLLQYGSFCTQLNRALTGIAVEQD
KNTQEVFAQVKQIYKTPPIKDFGGFNFSQILPDPSKPSKRSFIEDLLFNKVTLADAGFIKQ
YGDCLGDIAARDLICAQKFNGLTVLPPLLTDEMIAQYTSALLAGTITSGWTFGAGAALQ
IPFAMQMAYRFNGIGVTQNVLYENQKLIANQFNSAIGKIQDSLSSTASALGKLQDVVNQ
NAQALNTLVKQLSSNFGAISSVLNDILSRLDPPEAEVQIDRLITGRLQSLQTYVTQQLIRA
AEIRASANLAATKMSECVLGQSKRVDFCGKGYHLMSFPQSAPHGVVFLHVTYVPAQEK
NFTTAPAICHDGKAHFPREGVFVSNGTHWFVTQRNFYEPQIITTDNTFVSGNCDVVIGIV
NNTVYDPLQPELDSFKEELDKYFKNHTSPDVDLGDISGINASVVNIQKEIDRLNEVAKNL
NESLIDLQELGKYEQYIKWPWYIWLGFIAGLIAIVMVTIMLCCMTSCCSCLKGCCSCGSC
C

Fig. 74 atgttcgtgttcctggtgctgctgccgctggtgagcagccagtgcgtgaacctgacgacccgtacacaactaccacctgcgtacacaaata
gcttcaccagaggcgtgtactaccctgataaagtgttcagatcttctgtgctgcacagcacccaggatctgttcctgccgttcttctccaacgt
gacctggttccatgccatccacgtgtctggaacaaacggcaccaagagagtttgacaaccctgtgctaccccttcaatgacggcgtctactttgc
tagcaccgagaagagcaatatcatccgcggctggatcttcggcaccaccctggactccaagacccagtccctgctgattgtgaacaacgc
caccaacgtggtgatcaaggtctgcgaattccagttctgtaacgacccattcctgggcgtgtattatcataagaacaataagagctggatgga
atcagagttccgggtgtactcttctgccaacaactgcaccttcgagtacgtgtctcagcctttcctcatggacctggagggcaagcagggca
acttcaagaacctgagggagtttgtgttcaagaacatcgacgggtacttcaagatctacagcaagcacacacccatcaatctggtgcgaga
cctgcctcagggcttctcggctctggaaccccttggtggatctgcccatcggcatcaacatcaccagattccagacactgctggctcttcacag
aagctacctgacgcctggagatagcagcagcggctggaccgccggagccgccgcctattacgtgggctacctgcagcccagaacgttc
ctgcttaagtacaacgagaacggtacaattaccgatgccgtggactgcgccttagacccgctgagcgagacaaagtgtacctgaagagc
tttacagtggagaaaggcatctaccagaccagtaacttcagagtgcagccaaccgaaagcatcgtgcggtttcctaatatcacaaacctgtg
tccatttggcgaggtgttcaacgcgaccagattcgcgtctgtctatgcctggaacagaaagcggatcagcaactgcgtggctgactatagc
gtgctttacaacagcgcctcctttagcaccttcaagtgctacggcgtcagtcccactaaactgaacgacctctgcttcaccaatgtgtacgcg
gatagcttcgtgatcagaggagacgaggtgcggcagattgcgcctggacagaccggcaagatcgccgactacaattacaagctgcctga
cgacttcacaggctgcgtgatcgcctggaactctaacaatctggacagcaaagtcggtggaaattataactacctgtaccgcctattcagaa
agtccaacctgaagccatttgaacgggacatctctaccgaaatctaccaggctggcagcactccttgtaatggcgtagagggcttcaactgt
tactttccactgcagagctacggcttccagcctaccaatggcgttggataccagccttacagagtggtggtgttgtcgtttgagctgcttcacg
cacctgctacagtctgtggccctaagaaatctaccaatctggtaaagaacaagtgcgtgaatttcaactttaacggcctgaccggcacagga
gtgctgactgagagcaataagaaattcctgcctttccagcagtttggcagagacatcgccgataccaccgacgccgtacgggatcctcaga
ccctggaaatcctggacatcacaccgtgtagcttcggcggagtcagcgtgatcacacctggaacaaacacatccaaccaggtggccgtgc
tgtaccaggacgtaaactgtacagaggtgccagtggccattcacgccgatcagctgacacctacctggcgggtttatagcacgggcagca
acgtcttccagacccgggccggctgcctgatcggcgctgaacacgtgaacaacagctacgagtgcgacatccctatcggagcgggcatc
tgcgccagctaccagacgcagacaaacagccctggctccgcctcttcggttgccagccagagtatcatcgcctacaccatgagtctgggga
gccgagaatagcgtggcctacagcaacaacagcatcgctattcccaccaatttcaccatcagcgtgaccaccgaaatcctgcctgtgagca
tgaccaagaccagcgtagactgcaccatgtacatctgcggcgactcaaccgaatgtagcaacctgctgctccagtacggcagcttctgcac
ccagctgaacagagctctgacgggcatcgctgtggaacaagacaagaacacccaggaggtgttcgcccaagtgaaacagatctacaag
actcctcctatcaaggacttcggaggcttcaatttctctcagatcttgccagatcctagcaagccaagcaagcggagcttcatcgaagacctt
ctgtttaacaaggtgacactggccgacgccgggttcatcaagcagtacggcgactgtctcggagacatcgctgccagagacctcatctgc
gcccagaaattcaacggcctgactgtgctgcctcctctgctcacagacgagatgatcgcccagtacaccagcgccctcctggccggcacc
atcaccagcggctggacgtttggtgctggtgccgccctgcagatccctttcgccatgcagatggcctatcgcttcaacggaatcggcgtga
cacagaacgtgctgtacgagaaccagaagctgatcgccaaccagtttaacagcgctatcggcaagatccaagactctctgagttctacagc
ctctgccctgggcaaactgcaggacgtggtcaaccagaacgcccaggcgctgaatacccctggtgaagcagctgagcagcaatttcggtg
cgatcagcagcgtgctgaacgacatcctgagcagactggatccgcctgaggccgaagtccagatcgatagactgatcaccggcagactg
caatctctgcagacatacgtgacccagcagctgatccgggctgcggagatccgggccagcgctaacctggccgccaccaagatgagcg
agtgcgtgctgggccagtctaagagggttgacttctgcggtaagggctaccacctgatgagcttcccacagtctgcgcctcacggcgttgt
gttcctgcacgtgacctacgtgcctgctcaggagaagaacttcaccaccgcgccggccatctgccacgacggcaaggcccacttcccaa
gagagggtgtatttgtgtctaacggcacccactggttcgtgacacaaaggaacttctacgagcctcagatcataaccaccgacaacaccttc
gtgagcggaaactgcgacgtggtgatcggcatcgtgaacaacaccgtgtacgaccctctgcagcctgagctggacagcttcaaagaaga
actagacaagtacttcaagaaccacaccagtcccgatgtggacttgggcgatatctctggcattaacgccagcgtcgtgaacatccagaag
gagatcgatagactgaacgaggtggccaagaacctgaacgaatcactgatcgacctgcaggagctgggaaagtacgagcagtacatcaa
gtggccctggtatatctggctgggcttcatcgctggactgatcgccatcgtgatggtgaccatcatgctgtgctgcatgacatcctgctgttcc
tgcctgaagggctgttgcagctgtggtagctgctgcaagttcgatgaggatgactcagagcctgtgctcaagggagtgaagctgcactaca
cctga

Fig. 75 atgtttgtattcttagtcttgttaccactagtgtcgtctcagtgcgtcaaccttaccacgcgtactcagctaccacctgcctacaccaatagtttca
cgcgaggagtttattacccggataaggtcttcagatcgtcggtcctacacagtacgcaagacttgttccttcctttcttcagtaatgtaacatggt
tccacgctattcacgtttccggtacaaatggaacgaaacgtttcgataacccagtcttaccgttcaatgacggtgtatatttcgcatctacagag
aagtcgaatataatccgtggatggatcttcggaaccactttagattccaagactcagtcgttgttgattgtcaacaatgcaacaaatgtcgtgat
caaagtttgtgagtttcaattctgtaatgacccattcttaggtgtgtactaccataagaataacaagtcatggatggaatcagaatttcgtgtctat
tcttcggcgaacaactgcactttcgagtatgtgagtcaacctttcctaatggacctagagggaaagcagggtaactttaagaatcttcgagaat
tcgtctttaagaatattgacggttacttcaagatctattccaagcacactcccataaacttggtccgagatctaccacagggtttctccgctctag
aacccttagtggatcttcctataggaatcaacatcacgagattccagacattgttagcattgcatcgatcctatcttacgcctggagattcttcat
cgggatggactgcaggagccgctgcgtactatgtgggatacttacagcctcgaacattcctacttaagtacaatgagaacggaactatcaca
gacgcggtggactgtgctttggacccattgtcggagacaaagtgtacccttaagtcattcactgtcgagaagggaatttatcaaacgtccaac
tttcgtgtgcagccaacagaatccatagtcagatttccaaacattacgaatctttgcccgttcggtgaagtctttaacgccacccgttcgcatc
cgtttacgcctggaacagaaagagaatctcgaactgcgtggcggactattctgtactttataactcagcttcattctcaacattcaagtgttatg
gtgtgtcgccaacaaagctaaatgatctatgcttcaccaacgtatacgcggattcgttcgtaattagaggtgatgaggtgcgacagatcgctc
ctggacagacaggaaagatagctgattacaattacaagttaccggatgatttcaccggttgcgtgatcgcttggaattctaacaatttggactc
caaagttggaggaaactacaactacttatatcgattatttagaaagtccaacttgaaaccttttcgagcgtgacataagtacggagatctatcag
gccggatcgacaccatgcaatggtgtggagggtttcaattgttactttccacttcaaagttacggattccaaccgacgaacggagtgggttac
cagccgtatcgagtcgtagtcctatcatttgagttgctacatgctccagcgaccgtttgcggacctaagaagtccacgaacctagtaaagaac
aaatgcgtcaatttcaacttcaacggtttgactggaactggagtgttaactgagtccaacaagaaatttctaccgttccaacaatttggtagaga
cattgcagacacgacggatgcggtacgtgaccctcaaactttagagatcttagacataacgccttgctccttcggaggagtttccgtgattac
gcctggaaccaatacctcaaaccaagtcgctgtgctataccaggatgtgaactgcaccgaggttccagtagctattcacgctgatcagctaa
cgcctacttggagagtatattcgactggatctaacgtgttccagacacgagctggatgtcttattggtgcagagcatgtcaataactcttatgaa
tgtgatattccaattggtgcgggaatttgcgcatcataccagacacaaaccaacagtcccggatcagcttcatccgtcgcttcgcaatctatca
ttgcttacactatgagtctaggagctgagaactcagttgcgtacagtaacaacagtatcgctatacctactaactttacaataagtgtcaccact
gaaatcttaccagtatccatgacgaagacctccgttgattgtacaatgtatatatgtggagattcaaccgagtgcagtaacttgttacttcagtat
ggatccttctgcacacaattgaatcgagcccttaccggtatcgccgtagaacaagataagaacacacaggaggtctttgctcaggtcaagc
agatttacaagacaccgccaatcaaggacttcggtggattcaatttctctcagatccttcccgacccgtccaaaccgtctaaacgatcgtttat
cgaagatttattgttcaataaggttactttggcggacgctggtttcattaagcagtatggagactgtcttggtgacattgctgcgcgtgaccttat
atgcgcccagaagttcaatggacttacagttctaccgccacttctaaccgatgaaatgatcgcgcagtatacatctgcattgttggccggtac
gattacatctggatggactttcggtgctggagcagctttgcaaattccgttcgcgatgcaaatggcatacagattcaacggaatcggagtaac
gcagaatgtgctatatgagaaccagaaacttatagcaaaccaattcaactcggccatcggtaagattcaggattcgttgtcgagtacagcca
gtgcgcttggaaagctacaggacgtagttaatcagaatgcgcaagccttgaacacgttagttaagcaactatcttccaactttggtgccatttc
ttctgtgttgaacgacattctatctcgattagacccacctgaggccgaggttcaaattgatcgattaataaccggaagattgcagtcgctacaa
acatatgtaactcagcaattaattagagctgcggaaattcgagcttctgcgaaccttgccgcgacgaagatgtcggaatgcgtgttaggtca
gtcaaagcgagtggacttctgtggaaaagggataccaccttatgtcctttccgcaatctgcgccacacggtgtggtgtttctacatgtgacctat
gtacctgcacaagagaagaactttacgacagcaccagccatctgtcatgatggaaaggcccactttccacgagaaggagtatttgtgtcca
atggtacacactggtttgttacccaacgaaatttctatgaaccgcagatcatcacaactgataacacgttcgtctctggaaactgtgacgtagtt
ataggaattgtcaacaatactgtctacgacccattacagccggagcttgattcattcaaagaggagttggataagtacttcaagaaccacacc
agtccggatgtggatttaggtgatatctccggtattaacgcttccgtcgttaatatacagaaggaaatcgaccgacttaatgaagtagcaaag
aaccttaatgaatccctaatcgatctacaagaacttggtaaatatgagcaatatatcaagtggccttggtacatttggttgggtttcattgcagga
ttgattgcgattgttatggtcacaataatgctttgttgtatgacgagttgttgttcgtgtttgaagggatgctgctcatgtggttcttgttgtaaattcg
atgaagacgattcagaaccggtattgaaaggagttaagttgcactacacgtaa

Fig. 76 atgtctgataatggcccgcagaatcagcgcaacgcacctagaatcacatttggcggtcccagcgactctaccggcagcaaccagaacgg
agaacggagcggagccagaagcaagcaaagacgccctcagggactgcctaacaacaccgccagctggttcactgctctgacccagca
cggtaaagaggatctgaagtttcctagaggccaaggagttcctatcaacaccaacagcagcccagacgatcagatcggctactatagaag
agccacaagaagaatccgaggcggcgacggcaagatgaaggacctgtcacctagatggtacttctactacctgggcacaggtcccgaag
ccgggctgccttatggcgcaaataaggacggaatcatctgggtggccacagaaggcgccctgaatacacccaaggaccacatcggcac
cagaaacccggccaacaacgccgctatagtgctgcagctgccacagggtaccacgctgccaaagggcttctacgctgagggaagcaga
ggaggctctcaggcctcttccagaagctcttccagaagcagaaactccagcagaaatagcactcccggcagtagcagaggcacaagccc
tgctagaatggccggtaatggaggcgacgccgcgctggccctcctgctgctggatcggctgaaccagctggaatctaagatgagcggca
agggccagcaacagcagggccagacagtgaccaagaaatctgccgccgaggctagcaagaaacctcggcagaagaggaccgccacc
aaggcctacaacgtgacacaggccttcggtcgtcgcggtcccgagcagacacagggcaacttcggcgaccaggagctgatcagacaag
gcacagattacaaacattggcctcagatcgcccagttcgctccaagcgcctctgctttcttcggcatgagcagaatcggcatggaagtgacg
ccttcaggcacatggctgacctacaccggcgccatcaagctggacgataaggacccgaacttcaaggaccaggtgatcctgctgaacaa
gcacatcgacgcctacaagaccttccctcctacagagcctaagaaggacaagaagaagaaagccgatgaaacccaggccctgcctcag
cggcagaagaagcaacagaccgtgaccctgctgcctgccgccgatctggacgacttcagcaaacaactgcagcaatccatgagctctgc
cgatagcacccaggcctga

Fig. 77 atgtcggataacggtccacagaaccaaagaaatgcacctcgaattacgtttggtggtccttccgactccactggatcgaatcagaatggtga
gagaagtggtgcgagatctaaacaacgaagaccgcaaggtttgccgaacaatacagcctcgtggttcaccgcccttacacaacatggtaa
agaggacctaaagtttcctcgtggacaaggtgtgcctatcaatacgaattcgagtccggatgatcagattggttattatcgacgagccacga
gacgaattcgaggaggtgacggaaagatgaaggacttgtcaccacgttggtatttctactatttgggtacgggacctgaggccggacttcca
tatggagctaacaaggacggtatcatttgggtggcgaccgaaggagctcttaacacaccaaaggatcatataggtacgcgtaaccctgcta
acaacgcagccattgtgttacagttaccacaaggtacgacacttcccaaaggattctatgcggaaggttcccgtggaggatcgcaggcctc
gtcacgttcgtcctccagatcgagaaactcttcacgtaactctacgcctggtagttcccgaggaacgagtccggcaagaatggcaggtaat
ggaggtgatgctgccttagccctattactattagacagacttaatcaattagagagtaagatgtcaggaaagggtcagcaacaacaaggtca
gacagtgacaaagaagtctgcggctgaggcatctaagaaaccgagacagaagagaacagctactaaggcgtacaacgtgactcaagca
tttggtcgtcgtggaccggaacagactcagggtaactttggtgaccaagagttaatacgtcaaggaactgactacaagcactggcctcagat
cgcacaattcgcaccgtcggcctcggctttcttcggaatgtcacgaataggtatggaggtaacaccctcgggaacgtggctaacgtacact
ggtgcgattaagcttgatgacaaggaccctaacttcaaagaccaagtcatcctacttaacaagcacatagacgcgtataagaccttccctcc
aactgaacccaagaaagataagaagaagaaagcagatgaaactcaagcattgcctcagcgtcagaagaagcaacagacggttacacttc
tacctgctgctgatcttgacgatttctcaaagcaattacaacagtcaatgagttcggctgactcaacccaggcttaa

Fig. 78 atgtttgtctttcttgtcttattgccactagtctctagtcagtgtgttaatcttacaaccagaactcaattaccacctgcatacactaattctttcacac
gtggtgtttattaccctgacaaagtattcagatcctcagtattacattcaactcaggacttgttcttacctttcttctccaatgttacttggttccatgc
tatacatgtctctgggaccaatggtactaagaggtttgataaccctgtcctaccatttaatgatggtgtttatttcgcttccactgagaagtctaac
ataataagaggctggatatttggtactactttagattcgaagacccagtccctacttattgttaataacgctactaatgttgttattaaagtctgtga
atttcaattctgtaatgatccattcttgggtgtttattaccacaagaacaacaagagttggatggaaagtgagttcagagtttattctagtgcgaat
aattgcactttcgaatatgtctctcagcctttccttatggaccttgaaggtaaacagggtaatttcaagaatcttagggaatttgtgtttaagaatat
tgatggttatttcaagatatattctaagcacacgcctattaatttagtgcgtgatctccctcagggtttctcggctttagaaccattggtagatttgc
caataggtattaacatcactaggtttcaaactttacttgctttacatagaagttatttgactcctggtgattcttcttcaggttggacagctggtgct
gcagcttattatgtgggttatcttcaacctaggactttcctattgaaatataatgagaatggaaccattacagatgctgtagactgtgcacttgac
cctctctcagaaacaaagtgtacgttgaaatccttcactgtagagaaaggaatctatcaaacttctaacttaagtccaaccaacagaatctat
tgttagatttcctaatattacaaacttgtgcccttcggtgaagtatttaacgccaccagatttgcatctgtttatgcttggaacaggaagagaatc
agcaactgtgttgctgattattctgtcctatataattccgcatcattctccacatttaagtgttatggagtgtctcctactaaattaaatgatctctgct
ttactaatgtctatgcagattcatttgtaattagaggtgatgaagtcagacaaatcgctccagggcaaactggaaagattgctgattataattata
aattaccagatgactttacaggctgcgttatagcttggaattctaacaatcttgattctaaggttggtggtaattataattacctgtatagattgttta
ggaagtctaatctcaaacctttcgagagagatatttcaactgaaatctatcaggccggtagcacaccttgtaatggtgttgaaggatttaattgtt
actttcctttacaatcatatggtttccaacccactaatggtgttggttaccaaccatacagagtagtagtactttcatttgaacttctacatgcacca
gcaactgtttgtggacctaagaagtctactaatttggttaagaacaaatgtgtcaatttcaacttcaatggtttaacaggcacaggtgttcttact
gagtctaacaagaagtttctgcctttccaacaatttggcagagacattgctgacactactgatgctgtccgtgatccacagacacttgagattct
tgacattacaccatgttcatttggtggtgtcagtgttataacaccaggaacaaatacttctaaccaggttgctgttctttatcaggatgttaactgc
acagaagtccctgttgctattcatgcagatcaacttactcctacttggcgtgtttattctacaggttctaatgtatttcaaacacgtgcaggctgttt
aataggagctgaacatgtcaacaactcatatgagtgtgacatacccattggtgcaggtatatgcgctagttatcagactcagactaattctcct
cggcgggcacgtagtgtagctagtcaatccatcattgcctacactatgtcataa

Fig. 79

MFVFLVLLPLVSSQCVNLTTRTQLPPAYTNSFTRGVYYPDKVFRSSVLHSTQDLFLPFFS
NVTWFHAIHVSGTNGTKRFDNPVLPFNDGVYFASTEKSNIIRGWIFGTTLDSKTQSLLIV
NNATNVVIKVCEFQFCNDPFLGVYYHKNNKSWMESEFRVYSSANNCTFEYVSQPFLMD
LEGKQGNFKNLREFVFKNIDGYFKIYSKHTPINLVRDLPQGFSALEPLVDLPIGINITRFQ
TLLALHRSYLTPGDSSSGWTAGAAAYYVGYLQPRTFLLKYNENGTITDAVDCALDPLS
ETKCTLKSFTVEKGIYQTSNFRVQPTESIVRFPNITNLCPFGEVFNATRFASVYAWNRKRI
SNCVADYSVLYNSASFSTFKCYGVSPTKLNDLCFTNVYADSFVIRGDEVRQIAPGQTGK
IADYNYKLPDDFTGCVIAWNSNNLDSKVGGNYNYLYRLFRKSNLKPFERDISTEIYQAG
STPCNGVEGFNCYFPLQSYGFQPTNGVGYQPYRVVVLSFELLHAPATVCGPKKSTNLV
KNKCVNFNFNGLTGTGVLTESNKKFLPFQQFGRDIADTTDAVRDPQTLEILDITPCSFGG
VSVITPGTNTSNQVAVLYQDVNCTEVPVAIHADQLTPTWRVYSTGSNVFQTRAGCLIGA
EHVNNSYECDIPIGAGICASYQTQTNSPRRARSVASQSIIAYTMS

Fig. 80 atgtttgtctttcttgtcttattgccactagtctctagtcagtgtgttaatcttacaaccagaactcaattaccacctgcatacactaattctttcacac
gtggtgtttattaccctgacaaagtattcagatcctcagtattacattcaactcaggacttgttcttacctttcttctccaatgttacttggttccatgc
tatacatgtctctgggaccaatggtactaagaggtttgataaccctgtcctaccatttaatgatggtgtttatttcgcttccactgagaagtctaac
ataataagaggctggatatttggtactactttagattcgaagacccagtccctacttattgttaataacgctactaatgttgttattaaagtctgtga
atttcaattctgtaatgatccattcttgggtgtttattaccacaagaacaacaagagttggatggaaagtgagttcagagtttattctagtgcgaat
aattgcactttcgaatatgtctctcagcctttccttatggaccttgaaggtaaacagggtaatttcaagaatcttagggaatttgtgtttaagaatat
tgatggttatttcaagatatattctaagcacacgcctattaatttagtgcgtgatctccctcagggtttctcggctttagaaccattggtagatttgc
caataggtattaacatcactaggtttcaaactttacttgctttacatagaagttatttgactcctggtgattcttcttcaggttggacagctggtgct
gcagcttattatgtgggttatcttcaacctaggactttcctattgaaatataatgagaatggaaccattacagatgctgtagactgtgcacttgac
cctctctcagaaacaaagtgtacgttgaaatccttcactgtagagaaaggaatctatcaaacttctaactttagagtccaaccaacagaatctat
tgttagatttcctaatattacaaacttgtgcccctttcggtgaagtatttaacgccaccagatttgcatctgtttatgcttggaacaggaagagaatc
agcaactgtgttgctgattattctgtcctatataattccgcatcattctccacatttaagtgttatgggagtgtctcctactaaattaaatgatctctgct
ttactaatgtctatgcagattcatttgtaattagaggtgatgaagtcagacaaatcgctccagggcaaactggaaagattgctgattataattata
aattaccagatgactttacaggctgcgttatagcttggaattctaacaatcttgattctaaggttggtggtaattataattacctgtatagattgttta
ggaagtctaatctcaaacctttcgagagagatatttcaactgaaatctatcaggccggtagcacaccttgtaatggtgttgaaggatttaattgtt
actttcctttacaatcatatggtttccaacccactaatggtgttggttaccaaccatacagagtagtagtactttcatttgaacttctacatgcacca
gcaactgtttgtggacctaagaagtctactaatttggttaagaacaaatgtgtcaatttcaacttcaatggtttaacaggcacaggtgttcttact
gagtctaacaagaagtttctgcctttccaacaatttggcagagacattgctgacactactgatgctgtccgtgatccacagacacttgagattct
tgacattacaccatgttcatttggtggtgtcagtgttataacaccaggaacaaatacttctaaccaggttgctgttctttatcaggatgttaactgc
acagaagtccctgttgctattcatgcagatcaacttactcctacttggcgtgtgtttattctacaggttctaatgtatttcaaacacgtgcaggctgttt
aataggagctgaacatgtcaacaactcatatgagtgtgacatacccattggtgcaggtatatgcgctagttatcagactcagactaattcttaa

Fig. 81

MFVFLVLLPLVSSQCVNLTTRTQLPPAYTNSFTRGVYYPDKVFRSSVLHSTQDLFLPFFS
NVTWFHAIHVSGTNGTKRFDNPVLPFNDGVYFASTEKSNIIRGWIFGTTLDSKTQSLLIV
NNATNVVIKVCEFQFCNDPFLGVYYHKNNKSWMESEFRVYSSANNCTFEYVSQPFLMD
LEGKQGNFKNLREFVFKNIDGYFKIYSKHTPINLVRDLPQGFSALEPLVDLPIGINITRFQ
TLLALHRSYLTPGDSSSGWTAGAAAYYVGYLQPRTFLLKYNENGTITDAVDCALDPLS
ETKCTLKSFTVEKGIYQTSNFRVQPTESIVRFPNITNLCPFGEVFNATRFASVYAWNRKRI
SNCVADYSVLYNSASFSTFKCYGVSPTKLNDLCFTNVYADSFVIRGDEVRQIAPGQTGK
IADYNYKLPDDFTGCVIAWNSNNLDSKVGGNYNYLYRLFRKSNLKPFERDISTEIYQAG
STPCNGVEGFNCYFPLQSYGFQPTNGVGYQPYRVVVLSFELLHAPATVCGPKKSTNLV
KNKCVNFNFNGLTGTGVLTESNKKFLPFQQFGRDIADTTDAVRDPQTLEILDITPCSFGG
VSVITPGTNTSNQVAVLYQDVNCTEVPVAIHADQLTPTWRVYSTGSNVFQTRAGCLIGA
EHVNNSYECDIPIGAGICASYQTQTNS

Fig. 82 atgtttgtctttcttgtcttattgccactagtctctagtaatattacaaacttgtgcccttcggtgaagtatttaacgccaccagatttgcatctgttta
tgcttggaacaggaagagaatcagcaactgtgttgctgattattctgtcctatataattccgcatcattctccacatttaagtgttatggagtgtct
cctactaaattaaatgatctctgctttactaatgtctatgcagattcatttgtaattagaggtgatgaagtcagacaaatcgctccagggcaaact
ggaaagattgctgattataattataaattaccagatgactttacaggctgcgttatagcttggaattctaacaatcttgattctaaggttggtggta
attataattacctgtatagattgtttaggaagtctaatctcaaacctttcgagagagatatttcaactgaaatctatcaggccggtagcacacctt
gtaatggtgttgaaggatttaattgttactttcctttacaatcatatggtttccaacccactaatggtgttggttaccaaccatacagagtagtagta
ctttcatttgaacttctacatgcaccagcaactgtt

Fig. 83

MFVFLVLLPLVSSNITNLCPFGEVFNATRFASVYAWNRKRISNCVADYSVLYNSASFSTF
KCYGVSPTKLNDLCFTNVYADSFVIRGDEVRQIAPGQTGKIADYNYKLPDDFTGCVIAW
NSNNLDSKVGGNYNYLYRLFRKSNLKPFERDISTEIYQAGSTPCNGVEGFNCYFPLQSY
GFQPTNGVGYQPYRVVVLSFELLHAPATV

Fig. 84 atgtttgtctttcttgtcttattgccactagtctctagtagagtccaaccaacagaatctattgttagatttcctaatattacaaacttgtgccctttcg
gtgaagtatttaacgccaccagatttgcatctgtttatgcttggaacaggaagagaatcagcaactgtgttgctgattattctgtcctatataattc
cgcatcattctccacatttaagtgttatggagtgtctcctactaaattaaatgatctctgctttactaatgtctatgcagattcatttgtaattagaggt
gatgaagtcagacaaatcgctccagggcaaactggaaagattgctgattataattataaattaccagatgactttacaggctgcgttatagctt
ggaattctaacaatcttgattctaaggttggtggtaattataattacctgtatagattgtttaggaagtctaatctcaaacctttcgagagagatatt
tcaactgaaatctatcaggccggtagcacaccttgtaatggtgttgaaggatttaattgttactttcctttacaatcatatggtttccaacccacta
atggtgttggttaccaaccatacagagtagtagtactttcatttgaacttctacatgcaccagcaactgtttgtggacctaagaagtctactaattt
ggttaagaacaaatgtgtcaatttc

Fig. 85

MFVFLVLLPLVSSRVQPTESIVRFPNITNLCPFGEVFNATRFASVYAWNRKRISNCVADY
SVLYNSASFSTFKCYGVSPTKLNDLCFTNVYADSFVIRGDEVRQIAPGQTGKIADYNYK
LPDDFTGCVIAWNSNNLDSKVGGNYNYLYRLFRKSNLKPFERDISTIYQAGSTPCNGVE
GFNCYFPLQSYGFQPTNGVGYQPYRVVVLSFELLHAPATVCGPKKSTNLVKNKCVNF

Fig. 86 atgtttgtctttcttgtcttattgccactagtctctagtcagtgtgttaactttacaaccagaactcaattaccacctgcatacactaattctttcacac
gtggtgtttattaccctgacaaagtattcagatcctcagtattacattcaactcaggacttgttcttacctttcttctccaatgttacttggttccatgc
tatacatgtctctgggaccaatggtactaagaggtttgctaaccctgtcctaccatttaatgatggtgtttatttcgcttccactgagaagtctaac
ataataagaggctggatatttggtactactttagattcgaagacccagtccctacttattgttaataacgctactaatgttgttattaaagtctgtga
atttcaattctgtaatgatccattcttgggtgtttattaccacaagaacaacaagagttggatggaaagtgagttcagagtttattctagtgcgaat
aattgcactttcgaatatgtctctcagcctttccttatggaccttgaaggtaaacagggtaatttcaagaatcttagggaatttgtgtttaagaatat
tgatggttatttcaagatatattctaagcacacgcctattaatttagtgcgtggtctccctcagggtttctcggctttagaaccattggtagatttgc
caataggtattaacatcactaggtttcaaacttttacatataagttatttgactcctggtgattcttcttcaggttggacagctggtgctgcagcttat
tatgtgggttatcttcaacctaggactttcctattgaaatataatgagaatggaaccattacagatgctgtagactgtgcacttgaccctctctca
gaaacaaagtgtacgttgaaatccttcactgtagagaaaggaatctatcaaacttctaactttagagtccaaccaacagaatctattgttagatt
cctaatattacaaacttgtgcccttccggtgaagtatttaacgccaccagatttgcatctgtttatgcttggaacaggaagagaatcagcaactg
tgttgctgattattctgtcctatataattccgcatcattctccacatttaagtgttatggagtgtctcctactaaattaaatgatctctgctttactaatg
tctatgcagattcatttgtaattagaggtgatgaagtcagacaaatcgctccagggcaaactggaaatattgctgattataattataaaattacca
gatgactttacaggctgcgttatagcttggaattctaacaatcttgattctaaggttggtggtaattataattacctgtatagattgtttaggaagtc
taatctcaaacctttcgagagagatatttcaactgaaatctatcaggccggtagcacaccttgtaatggtgttaaaggatttaattgttacttttcctt
tacaatcatatggtttccaacccacttatggtgttggttaccaaccatacagagtagtagtactttcatttgaacttctacatgcaccagcaactgt
ttgtggacctaagaagtctactaatttggttaagaacaaatgtgtcaatttcaacttcaatggtttaacaggcacaggtgttcttactgagtctaac
aagaagtttctgcctttccaacaatttggcagagacattgctgacactactgatgctgtccgtgatccacagacacttgagattcttgacattac
accatgttcatttggtggtgtcagtgttataacaccaggaacaaatacttctaaccaggttgctgttctttatcagggtgttaactgcacagaagt
ccctgttgctattcatgcagatcaacttactcctacttggcgtgtgtttattctacaggttctaatgtatttcaaacacgtgcaggctgtttaataggag
ctgaacatgtcaacaactcatatgagtgtgacatacccattggtgcaggtatatgcgctagttatcagactcagactaattctcctcggcgggc
acgtagtgtagctagtcaatccatcattgcctacactatgtcacttggtgtagagaattcagttgcttactctaataactctattgccatacccaca
aactttactattagtgttaccacagaaattctaccagtgtctatgaccaagacatcagtagattgtacaatgtacatttgtggtgattcaactgaat
gcagcaatctattgttgcaatatggcagtttctgtacacaattaaaccgtgctttaactggaatagctgttgaacaagacaagaacacccaaga
agtatttgcacaagtcaaacaaatttacaagacaccaccaattaaagatttcggtggatttaatttctcacaaatattaccagatccatctaaacc
aagcaagaggtcatttattgaagatctactattcaacaaagtgacacttgcagatgctggcttcatcaaacaatatggtgattgccttggtgata
ttgctgctagagacctcatttgtgcacagaagtttaacggccttactgtattgccacctttgctcacagatgaaatgattgctcaatacacttctg
cactgttagcgggtacaatcacttctggttggacctttggtgcaggtgctgcattacaaataccatttgctatgcaaatggcttataggtttaatg
gtattggagttacacagaatgttctctatgagaaccagaaattgattgccaaccaatttaatagtgctattggcaagattcaagactcactttctt
ccacagcaagtgcacttggtaaacttcaagatgtggtcaaccagaatgcacaagctttaaacacgcttgttaaacaacttagctccaactttg
gtgcaatttcaagtgtattaaatgatatcctttcacgtcttgacaaagttgaggctgaagtgcaaattgataggttgatcacaggcagacttcaa
agtttgcagacatatgtgactcaacaattaattagagctgcagaaatcagagcttctgctaatcttgctgctactaagatgtcagagtgtgtactt
ggacaatcaagagagttgatttctgtggaaagggctatcatcttatgtccttccctcagtcagcacctcatggtgtagtcttcttgcatgtgactt
atgtccctgcacaagagaagaacttcacaactgctcctgccatttgtcatgatggtaaagcacactttcctcgtgaaggtgtctttgtttcaaat
ggcacacactggtttgtaacacaaaggaatttctatgaaccacaaatcattactacagacaacacatttgtgtctggtaactgtgatgttgtaat
aggaattgtcaacaacacagtttatgatccttttgcaacctgaattagactcattcaaggaggagttagataaatatttcaagaatcatacatcac
cagatgttgatttaggtgacatctctggcattaatgcttcagttgtaaacattcagaaagaaattgaccgcctcaatgaggttgccaagaattta
aatgaatctctcatcgatctccaagaacttggaaagtatgagcagtatatcaaatggccatggtacatttggctaggtttcatagctggcttgatt
gccatagtaatggtgacaattatgctttgctgtatgaccagttgctgtagttgtctcaagggctgttgttcttgtggatcctgctgcaaatttgatg
aagacgactctgagccagtgctcaaaggagtcaaattacattacacataa

Fig. 87

MFVFLVLLPLVSSQCVNFTTRTQLPPAYTNSFTRGVYYPDKVFRSSVLHSTQDLFLPFFS
NVTWFHAIHVSGTNGTKRFANPVLPFNDGVYFASTEKSNIIRGWIFGTTLDSKTQSLLIV
NNATNVVIKVCEFQFCNDPFLGVYYHKNNKSWMESEFRVYSSANNCTFEYVSQPFLMD
LEGKQGNFKNLREFVFKNIDGYFKIYSKHTPINLVRGLPQGFSALEPLVDLPIGINITRFQ
TLHISYLTPGDSSSGWTAGAAAYYVGYLQPRTFLLKYNENGTITDAVDCALDPLSETKC
TLKSFTVEKGIYQTSNFRVQPTESIVRFPNITNLCPFGEVFNATRFASVYAWNRKRISNCV
ADYSVLYNSASFSTFKCYGVSPTKLNDLCFTNVYADSFVIRGDEVRQIAPGQTGNIADY
NYKLPDDFTGCVIAWNSNNLDSKVGGNYNYLYRLFRKSNLKPFERDISTEIYQAGSTPC
NGVKGFNCYFPLQSYGFQPTYGVGYQPYRVVVLSFELLHAPATVCGPKKSTNLVKNKC
VNFNFNGLTGTGVLTESNKKFLPFQQFGRDIADTTDAVRDPQTLEILDITPCSFGGVSVIT
PGTNTSNQVAVLYQGVNCTEVPVAIHADQLTPTWRVYSTGSNVFQTRAGCLIGAEHVN
NSYECDIPIGAGICASYQTQTNSPRRARSVASQSIIAYTMSLGVENSVAYSNNSIAIPTNFT
ISVTTEILPVSMTKTSVDCTMYICGDSTECSNLLLQYGSFCTQLNRALTGIAVEQDKNTQ
EVFAQVKQIYKTPPIKDFGGFNFSQILPDPSKPSKRSFIEDLLFNKVTLADAGFIKQYGDC
LGDIAARDLICAQKFNGLTVLPPLLTDEMIAQYTSALLAGTITSGWTFGAGAALQIPFAM
QMAYRFNGIGVTQNVLYENQKLIANQFNSAIGKIQDSLSSTASALGKLQDVVNQNAQA
LNTLVKQLSSNFGAISSVLNDILSRLDKVEAEVQIDRLITGRLQSLQTYVTQQLIRAAEIR
ASANLAATKMSECVLGQSKRVDFCGKGYHLMSFPQSAPHGVVFLHVTYVPAQEKNFT
TAPAICHDGKAHFPREGVFVSNGTHWFVTQRNFYEPQIITTDNTFVSGNCDVVIGIVNNT
VYDPLQPELDSFKEELDKYFKNHTSPDVDLGDISGINASVVNIQKEIDRLNEVAKNLNES
LIDLQELGKYEQYIKWPWYIWLGFIAGLIAIVMVTIMLCCMTSCCSCLKGCCSCGSCCK
FDEDDSEPVLKGVKLHYT

Fig. 88 atgtttgtctttcttgtcttattgccactagtctctagtcagtgtgttaatcttacaaccagaactcaattaccacctgcatacactaattctttcacac
gtggtgtttattaccctgacaaagtattcagatcctcagtattacattcaactcaggacttgttcttacctttcttctccaatgttacttggttccatgc
tatatctgggaccaatggtactaagaggtttgataaccctgtcctaccatttaatgatggtgtttatttcgcttccactgagaagtctaacataata
agaggctggatatttggtactactttagattcgaagacccagtccctacttattgttaataacgctactaatgttgttattaaagtctgtgaatttca
attctgtaatgatccattcttgggtgtttaccacaagaacaacaagagttggatggaaagtgagttcagagtttattctagtgcgaataattgca
ctttcgaatatgtctctcagcctttccttatggaccttgaaggtaaacagggtaatttcaagaatcttagggaatttgtgtttaagaatattgatggt
tatttcaagatatattctaagcacacgcctattaatttagtgcgtgatctccctcagggtttctcggctttagaaccattggtagatttgccaatag
gtattaacatcactaggtttcaaactttacttgctttacatagaagttatttgactcctggtgattcttcttcaggttggacagctggtgctgcagctt
attatgtgggttatcttcaacctaggactttcctattgaaatataatgagaatggaaccattacagatgctgtagactgtgcacttgaccctctctc
agaaacaaagtgtacgttgaaatccttcactgtagagaaaggaatctatcaaacttctaactttagagtccaaccaacagaatctattgttagat
ttcctaatattacaaacttgtgccctttcggtgaagtatttaacgccaccagatttgcatctgtttatgcttggaacaggaagagaatcagcaact
gtgttgctgattattctgtcctatataattccgcatcattctccacatttaagtgttatggagtgtctcctactaaattaaatgatctctgctttactaat
gtctatgcagattcatttgtaattagaggtgatgaagtcagacaaatcgctccagggcaaactggaaagattgctgattataattataaattacc
agatgactttacaggctgcgttatagcttggaattctaacaatcttgattctaaggttggtggtaattataattacctgtatagattgtttaggaagt
ctaatctcaaacctttcgagagagatatttcaactgaaatctatcaggccggtagcacaccttgtaatggtgttgaaggatttaattgttacttttcc
tttacaatcatatggtttccaacccacttatggtgttggttaccaaccatacagagtagtagtactttcatttgaacttctacatgcaccagcaact
gtttgtggacctaagaagtctactaatttggttaagaacaaatgtgtcaatttcaacttcaatggtttaacaggcacaggtgttcttactgagtcta
acaagaagtttctgcctttccaacaatttggcagagacattgatgacactactgatgctgtccgtgatccacagacacttgagattcttgacatt
acaccatgttcatttggtggtgtcagtgttataacaccaggaacaaatacttctaaccaggttgctgttcttatcaggggtgttaactgcacagaa
gtccctgttgctattcatgcagatcaacttactcctacttggcgtgtttattctacaggttctaatgtatttcaaacacgtgcaggctgtttaatagg
agctgaacatgtcaacaactcatatgagtgtgacatacccattggtgcaggtatatgcgctagttatcagactcagactaattctcatcggcgg
gcacgtagtgtagctagtcaatccatcattgcctacactatgtcacttggtgcagagaattcagttgcttactctaataactctattgccataccc
ataaactttactattagtgttaccacagaaattctaccagtgtctatgaccaagacatcagtagattgtacaatgtacatttgtggtgattcaactg
aatgcagcaatctattgttgcaatatggcagtttctgtacacaattaaaccgtgctttaactggaatagctgttgaacaagacaagaacaccca
agaagtatttgcacaagtcaaacaaattacaagacaccaccaattaaagatttcggtggatttaatttctcacaaatattaccagatccatctaa
accaagcaagaggtcatttattgaagatctactattcaacaaagtgacacttgcagatgctggcttcatcaaacaatatggtgattgccttggtg
atattgctgctagagacctcatttgtgcacagaagtttaacggccttactgtattgccacctttgctcacagatgaaatgattgctcaatacactt
ctgcactgttagcgggtacaatcacttctggttggacctttggtgcaggtgctgcattacaaataccatttgctatgcaaatggcttataggttta
atggtattggagttacacagaatgttctctatgagaaccagaaattgattgccaaccaatttaatagtgctattggcaagattcaagactcacttt
cttccacagcaagtgcacttggtaaacttcaagatgtggtcaaccagaatgcacaagctttaaacacgcttgttaaacaacttagctccaactt
tggtgcaatttcaagtgtattaaatgatatccttgcacgtcttgacaaagttgaggctgaagtgcaaattgataggttgatcacaggcagacttc
aaagtttgcagacatatgtgactcaacaattaattagagctgcagaaatcagagcttctgctaatcttgctgctactaagatgtcagagtgtgta
cttggacaatcaagagagttgatttctgtggaaagggctatcatcttatgtccttccctcagtcagcacctcatggtgtagtcttcttgcatgtga
cttatgtccctgcacaagagaagaacttcacaactgctcctgccatttgtcatgatggtaaagcacactttcctcgtgaaggtgtctttgtttcaa
atggcacacactggtttgtaacacaaaggaatttctatgaaccacaaatcattactacacacaacacatttgtgtctggtaactgtgatgttgta
ataggaattgtcaacaacacagtttatgatcctttgcaacctgaattagactcattcaaggaggagttagataaatatttcaagaatcatacatca
ccagatgttgatttaggtgacatctctggcattaatgcttcagttgtaaacattcagaaagaaattgaccgcctcaatgaggttgccaagaattt
aaatgaatctctcatcgatctccaagaacttggaaagtatgagcagtatatcaaatggccatggtacatttggctaggtttcatagctggcttga
ttgccatagtaatggtgacaattatgctttgctgtatgaccagttgctgtagttgtctcaagggctgttgttcttgtggatcctgctgcaaatttgat
gaagacgactctgagccagtgctcaaaggagtcaaattacattacacataa

Fig. 89

MFVFLVLLPLVSSQCVNLTTRTQLPPAYTNSFTRGVYYPDKVFRSSVLHSTQDLFLPFFS
NVTWFHAISGTNGTKRFDNPVLPFNDGVYFASTEKSNIIRGWIFGTTLDSKTQSLLIVNN
ATNVVIKVCEFQFCNDPFLGVYHKNNKSWMESEFRVYSSANNCTFEYVSQPFLMDLEG
KQGNFKNLREFVFKNIDGYFKIYSKHTPINLVRDLPQGFSALEPLVDLPIGINITRFQTLL
ALHRSYLTPGDSSSGWTAGAAAYYVGYLQPRTFLLKYNENGTITDAVDCALDPLSETK
CTLKSFTVEKGIYQTSNFRVQPTESIVRFPNITNLCPFGEVFNATRFASVYAWNRKRISNC
VADYSVLYNSASFSTFKCYGVSPTKLNDLCFTNVYADSFVIRGDEVRQIAPGQTGKIAD
YNYKLPDDFTGCVIAWNSNNLDSKVGGNYNYLYRLFRKSNLKPFERDISTEIYQAGSTP
CNGVEGFNCYFPLQSYGFQPTYGVGYQPYRVVVLSFELLHAPATVCGPKKSTNLVKNK
CVNFNFNGLTGTGVLTESNKKFLPFQQFGRDIDDTTDAVRDPQTLEILDITPCSFGGVSVI
TPGTNTSNQVAVLYQGVNCTEVPVAIHADQLTPTWRVYSTGSNVFQTRAGCLIGAEHV
NNSYECDIPIGAGICASYQTQTNSHRRARSVASQSIIAYTMSLGAENSVAYSNNSIAIPINF
TISVTTEILPVSMTKTSVDCTMYICGDSTECSNLLLQYGSFCTQLNRALTGIAVEQDKNT
QEVFAQVKQIYKTPPIKDFGGFNFSQILPDPSKPSKRSFIEDLLFNKVTLADAGFIKQYGD
CLGDIAARDLICAQKFNGLTVLPPLLTDEMIAQYTSALLAGTITSGWTFGAGAALQIPFA
MQMAYRFNGIGVTQNVLYENQKLIANQFNSAIGKIQDSLSSTASALGKLQDVVNQNAQ
ALNTLVKQLSSNFGAISSVLNDILARLDKVEAEVQIDRLITGRLQSLQTYVTQQLIRAAEI
RASANLAATKMSECVLGQSKRVDFCGKGYHLMSFPQSAPHGVVFLHVTYVPAQEKNF
TTAPAICHDGKAHFPREGVFVSNGTHWFVTQRNFYEPQIITTHNTFVSGNCDVVIGIVNN
TVYDPLQPELDSFKEELDKYFKNHTSPDVDLGDISGINASVVNIQKEIDRLNEVAKNLNE
SLIDLQELGKYEQYIKWPWYIWLGFIAGLIAIVMVTIMLCCMTSCCSCLKGCCSCGSCC
KFDEDDSEPVLKGVKLHYT

Fig. 90 atgtttgtctttcttgtcttattgccactagtctctattcagtgtgttaatcttacaaccagaactcaattaccacctgcatacactaattctttcacac
gtggtgtttattaccctgacaaagtattcagatcctcagtattacattcaactcaggacttgttcttacctttcttctccaatgttacttggttccatgc
tatacatgtctctgggaccaatggtactaagaggtttgataaccctgtcctaccatttaatgatggtgtttatttcgcttccactgagaagtctaac
ataataagaggctggatatttggtactactttagattcgaagacccagtccctacttattgttaataacgctactaatgttgttattaaagtctgtga
atttcaattctgtaatgatccattcttgggtgtttattaccacaagaacaacaagagttgcatggaaagtgagttcagagtttattctagtgcgaat
aattgcactttcgaatatgtctctcagcctttccttatggaccttgaaggtaaacagggtaatttcaagaatcttagggaatttgtgtttaagaatat
tgatggttatttcaagatatattctaagcacacgcctattaatttagtgcgtgatctccctcagggtttctcggctttagaaccattggtagatttgc
caataggtattaacatcactaggtttcaaactttacttgctttacatagaagttatttgactcctggtgattcttcttcaggttggacagctggtgct
gcagcttattatgtgggttatcttcaacctaggactttcctattgaaatataatgagaatggaaccattacagatgctgtagactgtgcacttgac
cctctctcagaaacaaagtgtacgttgaaatccttcactgtagagaaaggaatctatcaaacttctaactttagagtccaaccaacagaatctat
tgttagatttcctaatattacaaacttgtgccctttcggtgaagtatttaacgccaccagatttgcatctgtttatgcttggaacaggaagagaatc
agcaactgtgttgctgattattctgtcctatataattccgcatcattctccacatttaagtgttatggagtgtctcctactaaattaaatgatctctgct
ttactaatgtctatgcagattcatttgtaattagaggtgatgaagtcagacaaatcgctccagggcaaactggaaagattgctgattataattata
aattaccagatgactttacaggctgcgttatagcttggaattctaacaatcttgattctaaggttggtggtaattataattaccggtatagattgttt
aggaagtctaatctcaaacctttcgagagagatatttcaactgaaatctatcaggccggtagcacaccttgtaatggtgttgaaggatttaattg
ttactttcctttacaatcatatggtttccaacccactaatggtgttggttaccaaccatacagagtagtagtactttcatttgaacttctacatgcac
cagcaactgtttgtggacctaagaagtctactaatttggttaagaacaaatgtgtcaatttcaacttcaatggtttaacaggcacaggtgttctta
ctgagtctaacaagaagtttctgcctttccaacaatttggcagagacattgctgacactactgatgctgtccgtgatccacagacacttgagatt
cttgacattacaccatgttcatttggtggtgtcagtgttataacaccaggaacaaatacttctaaccaggttgctgttctttatcagggtgttaact
gcacagaagtccctgttgctattcatgcagatcaacttactcctacttggcgtgtgtttattctacaggttctaatgtatttcaaacacgtgcaggctg
tttaataggagctgaacatgtcaacaactcatatgagtgtgacatacccattggtgcaggtatatgcgctagttatcagactcagactaattctc
ctcggcgggcacgtagtgtagctagtcaatccatcattgcctacactatgtcacttggtgcagagaattcagttgcttactctaataactctattg
ccatacccacaaactttactattagtgttaccacagaaattctaccagtgtctatgaccaagacatcagtagattgtacaatgtacatttgtggtg
attcaactgaatgcagcaatctattgttgcaatatggcagtttctgtacacaattaaaccgtgctttaactggaatagctgttgaacaagacaag
aacacccaagaagtatttgcacaagtcaaacaaatttacaagacaccaccaattaaagatttcggtggatttaatttctcacaaatattaccaga
tccatctaaaccaagcaagaggtcatttattgaagatctactattcaacaaagtgacacttgcagatgctggcttcatcaaacaatatggtgatt
gccttggtgatattgctgctagagacctcatttgtgcacagaagtttaacggccttactgtattgccaccttttgctcacagatgaaatgattgctc
aatacacttctgcactgttagcgggtacaatcacttctggttggacctttggtgcaggtgctgcattacaaataccatttgctatgcaaatggctt
ataggtttaatggtattggagttacacagaatgttctctatgagaaccagaaattgattgccaaccaatttaatagtgctattggcaagattcaag
actcactttcttccacagcaagtgcacttggtaaacttcaagatgtggtcaaccagaatgcacaagctttaaacacgcttgttaaacaacttag
ctccaactttggtgcaatttcaagtgtattaaatgatatcctttcacgtcttgacaaagttgaggctgaagtgcaaattgataggttgatcacagg
cagacttcaaagtttgcagacatatgtgactcaacaattaattagagctgcagaaatcagagcttctgctaatcttgctgctactaagatgtcag
agtgtgtacttggacaatctaagagagttgatttctgtggaaagggctatcatcttatgtccttccctcagtcagcacctcatggtgtagtcttctt
gcatgtgacttatgtccctgcacaagagaagaacttcacaactgctcctgccatttgtcatgatggtaaagcacactttcctcgtgaaggtgtct
ttgtttcaaatggcacacactggtttgtaacacaaaggaatttctatgaaccacaaatcattactacagacaacacatttgtgtctggtaactgtg
atgttgtaataggaattgtcaacaacacagtttatgatcctttgcaacctgaattagactcattcaaggaggagttagataaatatttcaagaatc
atacatcaccagatgttgatttaggtgacatctctggcattaatgcttcagttgtaaacattcagaaagaaattgaccgcctcaatgaggttgcc
aagaatttaaatgaatctctcatcgatctccaagaacttggaaagtatgagcagtatatcaaatggccatggtacatttggctaggtttcatagc
tggcttgattgccatagtaatggtgacaattatgctttgctgtatgaccagttgctgtagttgtctcaaggggctgttgttcttgtggatcctgctgc
aaatttgatgaagacgactctgagccagtgctcaaaggagtcaaattacattacacataa

Fig. 91

MFVFLVLLPLVSIQCVNLTTRTQLPPAYTNSFTRGVYYPDKVFRSSVLHSTQDLFLPFFS
NVTWFHAIHVSGTNGTKRFDNPVLPFNDGVYFASTEKSNIIRGWIFGTTLDSKTQSLLIV
NNATNVVIKVCEFQFCNDPFLGVYYHKNNKSCMESEFRVYSSANNCTFEYVSQPFLMD
LEGKQGNFKNLREFVFKNIDGYFKIYSKHTPINLVRDLPQGFSALEPLVDLPIGINITRFQ
TLLALHRSYLTPGDSSSGWTAGAAAYYVGYLQPRTFLLKYNENGTITDAVDCALDPLS
ETKCTLKSFTVEKGIYQTSNFRVQPTESIVRFPNITNLCPFGEVFNATRFASVYAWNRKRI
SNCVADYSVLYNSASFSTFKCYGVSPTKLNDLCFTNVYADSFVIRGDEVRQIAPGQTGK
IADYNYKLPDDFTGCVIAWNSNNLDSKVGGNYNYRYRLFRKSNLKPFERDISTEIYQAG
STPCNGVEGFNCYFPLQSYGFQPTNGVGYQPYRVVVLSFELLHAPATVCGPKKSTNLV
KNKCVNFNFNGLTGTGVLTESNKKFLPFQQFGRDIADTTDAVRDPQTLEILDITPCSFGG
VSVITPGTNTSNQVAVLYQGVNCTEVPVAIHADQLTPTWRVYSTGSNVFQTRAGCLIGA
EHVNNSYECDIPIGAGICASYQTQTNSPRRARSVASQSIIAYTMSLGAENSVAYSNNSIAI
PTNFTISVTTEILPVSMTKTSVDCTMYICGDSTECSNLLLQYGSFCTQLNRALTGIAVEQD
KNTQEVFAQVKQIYKTPPIKDFGGFNFSQILPDPSKPSKRSFIEDLLFNKVTLADAGFIKQ
YGDCLGDIAARDLICAQKFNGLTVLPPLLTDEMIAQYTSALLAGTITSGWTFGAGAALQ
IPFAMQMAYRFNGIGVTQNVLYENQKLIANQFNSAIGKIQDSLSSTASALGKLQDVVNQ
NAQALNTLVKQLSSNFGAISSVLNDILSRLDKVEAEVQIDRLITGRLQSLQTYVTQQLIR
AAEIRASANLAATKMSECVLGQSKRVDFCGKGYHLMSFPQSAPHGVVFLHVTYVPAQE
KNFTTAPAICHDGKAHFPREGVFVSNGTHWFVTQRNFYEPQIITTDNTFVSGNCDVVIGI
VNNTVYDPLQPELDSFKEELDKYFKNHTSPDVDLGDISGINASVVNIQKEIDRLNEVAK
NLNESLIDLQELGKYEQYIKWPWYIWLGFIAGLIAIVMVTIMLCCMTSCCSCLKGCCSC
GSCCKFDEDDSEPVLKGVKLHYT

Fig. 92 atgtttgtctttcttgtcttattgccactagtctctagtcagtgtgttaactttacaaacagaactcaattaccatctgcatacactaattctttcacac
gtggtgtttattaccctgacaaagtattcagatcctcagtattacattcaactcaggacttgttcttacctttcttctccaatgttacttggttccatgc
tatacatgtctctgggaccaatggtactaagaggtttgataaccctgtcctaccatttaatgatggtgtttatttcgcttccactgagaagtctaac
ataataagaggctggatatttggtactactttagattcgaagacccagtccctacttattgttaataacgctactaatgttgttattaaagtctgtga
atttcaattctgtaattatccattcttgggtgtttattaccacaagaacaacaagagttggatggaaagtgagttcagagtttattctagtgcgaat
aattgcactttcgaatatgtctctcagcctttccttatggaccttgaaggtaaacagggtaatttcaagaatcttagcgaatttgtgtttaagaatat
tgatggttatttcaagatatattctaagcacacgcctattaatttagtgcgtgatctccctcagggtttctcggctttagaaccattggtagatttgc
caataggtattaacatcactaggtttcaaactttacttgctttacatagaagttatttgactcctggtgattcttcttcaggttggacagctggtgct
gcagcttattatgtgggttatcttcaacctaggactttcctattgaaatataatgagaatggaaccattacagatgctgtagactgtgcacttgac
cctctctcagaaacaaagtgtacgttgaaatccttcactgtagagaaaggaatctatcaaacttctaactttagagtccaaccaacagaatctat
tgttagatttcctaatattacaaacttgtgccctttcggtgaagtatttaacgccaccagatttgcatctgtttatgcttggaacaggaagagaatc
agcaactgtgttgctgattattctgtcctatataattccgcatcattctccacatttaagtgttatggagtgtctcctactaaattaaatgatctctgct
ttactaatgtctatgcagattcatttgtaattagaggtgatgaagtcagacaaatcgctccagggcaaactggaacgattgctgattataattata
aattaccagatgactttacaggctgcgttatagcttggaattctaacaatcttgattctaaggttggtggtaattataattacctgtatagattgttta
ggaagtctaatctcaaacctttcgagagagatatttcaactgaaatctatcaggccggtagcacaccttgtaatggtgttaaaggatttaattgtt
actttcctttacaatcatatggtttccaacccacttatggtgttggttaccaaccatacagagtagtagtactttcatttgaacttctacatgcacca
gcaactgtttgtggacctaagaagtctactaatttggttaagaacaaatgtgtcaatttcaacttcaatggttaacaggcacaggtgttcttact
gagtctaacaagaagtttctgcctttccaacaatttggcagagacattgctgacactactgatgctgtccgtgatccacagacacttgagattct
tgacattacaccatgttcatttggtggtgtcagtgttataacaccaggaacaaatacttctaaccaggttgctgttctttatcagggtgttaactgc
acagaagtccctgttgctattcatgcagatcaacttactcctacttggcgtgtgtttattctacaggttctaatgtatttcaaacacgtgcaggctgttt
aataggagctgaatatgtcaacaactcatatgagtgtgacatacccattggtgcaggtatatgcgctagttatcagactcagactaattctcctc
ggcgggcacgtagtgtagctagtcaatccatcattgcctacactatgtcacttggtgcagagaattcagttgcttactctaataactctattgcc
atacccacaaactttactattagtgttaccacagaaattctaccagtgtctatgaccaagacatcagtagattgtacaatgtacatttgtggtgatt
caactgaatgcagcaatctattgttgcaatatggcagtttctgtacacaattaaaccgtgctttaactggaatagctgttgaacaagacaagaa
cacccaagaagtatttgcacaagtcaaacaaatttacaagacaccaccaattaaagatttcggtggatttaatttctcacaaatattaccagatc
catctaaaccaagcaagaggtcatttattgaagatctactattcaacaaagtgacacttgcagatgctggcttcatcaaacaatatggtgattgc
cttggtgatattgctgctagagacctcatttgtgcacagaagtttaacggccttactgtattgccacctttgctcacagatgaaatgattgctcaa
tacacttctgcactgttagcgggtacaatcacttctggttggacctttggtgcaggtgctgcattacaaataccatttgctatgcaaatggcttat
aggtttaatggtattggagttacacagaatgttctctatgagaaccagaaattgattgccaaccaatttaatagtgctattggcaagattcaaga
ctcactttcttccacagcaagtgcacttggtaaacttcaagatgtggtcaaccagaatgcacaagctttaaacacgcttgttaaacaacttagct
ccaactttggtgcaatttcaagtgtattaaatgatatcctttcacgtcttgacaaagttgaggctgaagtgcaaattgataggttgatcacaggca
gacttcaaagtttgcagacatatgtgactcaacaattaattagagctgcagaaatcagagcttctgctaatcttgctgctattaagatgtcagag
tgtgtacttggacaatctaagagagttgatttctgtggaaagggctatcatcttatgtccttccctcagtcagcacctcatggtgtagtcttcttgc
atgtgacttatgtccctgcacaagagaagaacttcacaactgctcctgccatttgtcatgatggtaaagcacactttcctcgtgaaggtgtcttt
gtttcaaatggcacacactggtttgtaacacaaaggaatttctatgaaccacaaatcattactacagacaacacatttgtgtctggtaactgtga
tgttgtaataggaattgtcaacaacacagtttatgatcctttgcaacctgaattagactcattcaaggaggagttagataaatatttcaagaatca
tacatcaccagatgttgatttaggtgacatctctggcattaatgcttcatttgtaaacattcagaaagaaattgaccgcctcaatgaggttgccaa
gaatttaaatgaatctctcatcgatctccaagaacttggaaagtatgagcagtatatcaaatggccatggtacatttggctaggtttcatagctg
gcttgattgccatagtaatggtgacaattatgctttgctgtatgaccagttgctgtagttgtctcaagggctgttgttcttgtggatcctgctgcaa
atttgatgaagacgactctgagccagtgctcaaaggagtcaaattacattacacataa

Fig. 93

MFVFLVLLPLVSSQCVNFTNRTQLPSAYTNSFTRGVYYPDKVFRSSVLHSTQDLFLPFFS
NVTWFHAIHVSGTNGTKRFDNPVLPFNDGVYFASTEKSNIIRGWIFGTTLDSKTQSLLIV
NNATNVVIKVCEFQFCNYPFLGVYYHKNNKSWMESEFRVYSSANNCTFEYVSQPFLMD
LEGKQGNFKNLSEFVFKNIDGYFKIYSKHTPINLVRDLPQGFSALEPLVDLPIGINITRFQT
LLALHRSYLTPGDSSSGWTAGAAAYYVGYLQPRTFLLKYNENGTITDAVDCALDPLSE
TKCTLKSFTVEKGIYQTSNFRVQPTESIVRFPNITNLCPFGEVFNATRFASVYAWNRKRIS
NCVADYSVLYNSASFSTFKCYGVSPTKLNDLCFTNVYADSFVIRGDEVRQIAPGQTGTI
ADYNYKLPDDFTGCVIAWNSNNLDSKVGGNYNYLYRLFRKSNLKPFERDISTEIYQAGS
TPCNGVKGFNCYFPLQSYGFQPTYGVGYQPYRVVVLSFELLHAPATVCGPKKSTNLVK
NKCVNFNFNGLTGTGVLTESNKKFLPFQQFGRDIADTTDAVRDPQTLEILDITPCSFGGV
SVITPGTNTSNQVAVLYQGVNCTEVPVAIHADQLTPTWRVYSTGSNVFQTRAGCLIGAE
YVNNSYECDIPIGAGICASYQTQTNSPRRARSVASQSIIAYTMSLGAENSVAYSNNSIAIP
TNFTISVTTEILPVSMTKTSVDCTMYICGDSTECSNLLLQYGSFCTQLNRALTGIAVEQD
KNTQEVFAQVKQIYKTPPIKDFGGFNFSQILPDPSKPSKRSFIEDLLFNKVTLADAGFIKQ
YGDCLGDIAARDLICAQKFNGLTVLPPLLTDEMIAQYTSALLAGTITSGWTFGAGAALQ
IPFAMQMAYRFNGIGVTQNVLYENQKLIANQFNSAIGKIQDSLSSTASALGKLQDVVNQ
NAQALNTLVKQLSSNFGAISSVLNDILSRLDKVEAEVQIDRLITGRLQSLQTYVTQQLIR
AAEIRASANLAAIKMSECVLGQSKRVDFCGKGYHLMSFPQSAPHGVVFLHVTYVPAQE
KNFTTAPAICHDGKAHFPREGVFVSNGTHWFVTQRNFYEPQIITTDNTFVSGNCDVVIGI
VNNTVYDPLQPELDSFKEELDKYFKNHTSPDVDLGDISGINASFVNIQKEIDRLNEVAKN
LNESLIDLQELGKYEQYIKWPWYIWLGFIAGLIAIVMVTIMLCCMTSCCSCLKGCCSCGS
CCKFDEDDSEPVLKGVKLHYT

Fig. 94 atgtttgtcttcttggtccttctgccgcttgtttcttcacaatgtgtgaatttgaccacccgcacccagctgcctcctgcatatacgaattcattcac
tcgcggcgtgtactatccagataaagtctttcgatccagtgtactgcattcaacgcaagatctctttcttccattcttcagcaatgtgacctggttc
cacgcgatacacgtaagcggaaccaacggaacaaagagatttgacaatccagtactcccgtttaatgacggtgtctactttgcctctaccga
gaagtctaatatcataagagggtggatcttcggtacgacgctcgattctaagacgcaaagcctgcttattgttaataatgccaccaatgtcgtg
attaaggtatgcgaatttcaattctgtaacgatccattccttggagtttactatcataagaacaacaaatcctggatggaatcagagtttcgggtc
tacagctccgcaaataactgtacgtttgagtacgtgtcccagcccttcttatggatctcgaaggtaaacaaggcaatttcaagaatcttagag
aattcgtcttcaagaacatcgatggatactttaagatatactcaaagcatacgccgataaacctcgtgcgcgacctgccacagggattcagtg
cgcttgagccattggtagatcttcctataggaatcaacataactagatttcagacactgctggcgcttcatagatcctatctgactccaggtgac
tcctccagtggatggactgccggcgccgcggcttactacgtgggttatcttcagcctcgaacgtttcttctgaagtataacgagaacgggac
gataaccgatgcggtggattgcgcactggaccctcttagcgaaactaaatgtaccccttaagagctttacggttgagaagggtatttatcagac
tagtaactttcgcgtgcagcccacggaatcaattgtgcggtttcccaatattacaaacttgtgccctttcggcgaggtcttcaatgcaacgcgc
tttgcgtcagtttacgcctggaataggaagaggatatcaaactgcgtggctgactattctgtgctttacaactctgctagtttcagtacctttaagt
gttacggtgtgagtccgacgaagctcaatgatctttgtttcactaatgtatacgcggacagtttcgttatacgaggagacgaggtccggcaaa
tcgcacccggccaaacgggaaagattgctgactacaactacaaattgcccgatgactttacgggatgcgtcattgcatggaattctaataatc
tggatagcaaagtaggtggaaactataattatctctaccggctcttccgaaagagtaatctcaaaccgtttgaaagagatattagcacggaaa
tatatcaagccggctccacaccatgtaatggagttgaaggctttaattgttatttcccgttgcaaagttacggatttcagcccacgaacggtgtg
ggttatcaaccgtatcgggtcgtagttctcagcttcgagctgcttcatgcgcccgcgactgtttgcggtcctaagaagtcaaccaatctcgtaa
agaacaagtgtgtgaacttcaacttcaatggactcacagggacgggcgtgcttacggagtcaaacaagaagtttcttcctttccagcaattcg
gcagggacattgccgatacaacggacgcagttagggaccctcaaactcttgaaatcttggacataactccttgcagctttggcggcgtgagt
gtgataacacctggtaccaatacgtccaatcaggtagcagtactgtatcaggatgtcaattgcaccgaagtccctgtcgccattcatgccgac
caactgacgccaacatggcgagtatacagtaccgggtcaaacgtgttccagaccagggcaggctgtctcattggtgcggaacacgttaac
aacagttacgaatgcgatatacctattggtgctggcatctgtgcctcttaccagacccaaactaactcaccacgaagggcaagatcagttgc
cagtcagtctattatcgcttacacgatgtcactgggagctgagaactctgttgcttactcaaataattcaattgccatcccaacgaatttcactat
agtgtaacaacggaaattctgcccgtgtccatgaccaagacgtccgtcgattgtaccatgtacatatgcggtgacagcaccgaatgtagcaa
cctcctgctccaatatggtagcttctgcacacagctcaacagagcacttacaggtatcgccgtagagcaagacaagaacacacaagaagtg
ttcgctcaggtgaagcagatctacaagactccaccgataaaggacttcggtggctttaactttagccaaatcctgcccgacccttctaagcctt
ctaagagatcctttattgaggatctcttgttcaacaaagtcaccctcgctgacgcaggtttataaagcagtatggtgactgtctcggcgatata
gcagccagagacttgatctgcgcccagaagttcaacgggcttacggttcttccgccgctgcttactgatgaaatgatagctcaatacacatct
gctcttctcgctgggacaataacttccgggtggacgttcggagcgggtgccgccttgcaaattccctttgcgatgcagatggcttatcgcttc
aatggcataggcgttacccagaacgtgctgtacgagaatcagaaattgatcgccaaccagtttaattctgccatcggaaagatccaagattc
cctgtctagcactgcgtcagccctcggtaaactgcaggatgtggttaatcagaatgctcaggctctcaacactctggttaaacagctgtctag
caacttcggtgccatctcttcagttcttaacgatatattgagtaggcttgataaagtcgaggcagaggttcaaattgaccggttgatcacgggc
aggcttcaatcactgcaaacctacgtcactcaacaactgattcgcgcagcggaaatacgagcttcagctaatctcgcagcgactaagatgtc
cgagtgtgtgctcggtcagagcaagagagttgacttctgtgggaaagggtaccatctcatgtcatttcctcaatctgcaccgcacggagtagt
attcctccacgttacttatgtgccggcacaagagaagaacttcactactgcgccagccatttgtcacgacgggaaagcgcactttcccaggg
aaggagtcttcgtatcaaacggtacgcattggttcgtaacgcaaagaaacttctatgaaccacaaattatcacgacggataatacgtttgtctc
cgggaactgtgacgtggtaattggtattgtaaataacacagtttatgacccattgcaacctgaactggacagcttcaaggaggaattggacaa
gtatttcaagaaccataccagtccggacgtagacctcggcgatatctcaggaattaacgctagcgtggtgaatattcagaaagaaatagatc
gcctgaacgaagtagcgaagaaccttaacgaaagtttgattgatcttcaggagctgggtaaatacgagcaatacataaagtggccgtggta
catctggctcggctttatagctggcctgatcgccattgtgatggtgactattatgttgtgttgcatgactagctgctgttcatgtcttaagggatgc
tgcagctgcggtagctgctgtaaatttgacgaagacgatagcgagccggtactgaaaggtgtgaaacttcattacacataa

Fig. 95 atgttcgtgtttcttgtgttgttgccactggtttcatcccaatgtgtgaactttaccaccaggacgcagttgccaccagcttatactaattccttcac
tagaggagtgtactacccggacaaggtattccggtctagtgtccttcactccacgcaagacctgttccttccgttcttctccaatgtaacctggt
ttcacgccattcatgtttcaggcacgaatggcactaagcgcttcgccaacccagtactgccgtttaatgatggagtctacttcgcttcaacaga
gaagagcaatatcatacgaggctggatctttggtactaccttggattccaagacgcaatcccttcttattgtcaataatgcgaccaacgttgtaa
tcaaagtatgcgagtttcaattctgcaacgacccattcttgggcgtctattatcataagaataataagtcttggatggagtctgagttcagagtgt
attcatcagcgaacaattgcacattcgaatatgtatctcagccctttctcatggatctcgaagggaagcaagggaacttcaagaatctccgcg
agttcgtctttaagaacattgacggctatttcaagatatacagcaaacatactccaatcaacctggttcgaggactccctcagggcttctccgc
gctggaacccttggtggacctcccaataggcataaatatcacgaggttccaaacattgcacataagctatctgactccgggagacagttcca
gcggttggactgcaggcgcggctgcgtactacgtgggctacttgcaacctaggacgtttctcttgaaatacaatgagaacggcaccatcac
ggatgcagttgactgtgctctcgacccactctccgaaaccaagtgtacgctcaagtcatttaccgtcgagaaaggaatctaccaaactagta
atttccgcgttcagcctacagagtcaattgtgcgatttcctaacatcactaacctgtgcccgtttggagaagtatttaatgcgactcgcttcgcta
gtgtctatgcgtggaatcgaaagcggatctcaaactgtgtggcagattattccgtcctgtataatagtgccagcttctcaacgtttaaatgctac
ggagttagcccaacgaagctgaacgacttgtgctttacgaacgtgtatgccgattccttcgtcatccgcggagacgaagttcgccaaatcgc
accaggtcaaacgggtaatatagcggactacaactacaagctgcccgacgatttcactgggtgcgtgatcgcgtggaatagtaacaacttg
gactccaaagtgggtggcaactacaactatctgtataggctgtttcgaaagtccaacttgaaaccgtttgaaagggatattagtacagagatct
atcaagctggtagcacaccctgcaacggtgttaaaggctttaactgctactttcctttgcagagctatggatttcagcctacttatggagtcggt
taccaaccttatcgcgtcgtagtactgagtttcgaactccttcatgcacccgcaactgtgtgcgggccaaagaagtctaccaatttggtcaag
aataagtgtgtaaacttcaacttcaacggtctcacagggaccggtgtattgacagagtcaaacaagaagttcttgcccttcaacagttcggc
agggatattgctgacactaccgatgcggttagggaccctcaaaccctggagattcttgacattacaccgtgcagcttcggtggagtcagcgt
tatcacaccaggcactaatacgtccaatcaagttgctgtactgtaccaaggagtcaattgtaccgaggtaccagtagcgattcacgccgacc
aactcacgcccacatggcgcgtctatagcacaggcagcaatgtatttcaaacgcgcgcaggatgtctcattggagcggagcatgtcaataa
ctcatacgaatgtgacattccaataggagcgggtatttgtgccagctaccagacgcaaacgaattctccacgccgagccagatcagtcgcg
agtcagagtataatagcgtacacgatgtctctgggcgtcgagaattccgtcgcatactcaaacaattccattgcgatcccaacgaacttcaca
atatccgtcaccactgaaatcctccctgttagcatgactaagacaagcgtggactgcactatgtatatttgtggtgattccacggaatgctctaa
tctgcttctccaatatggaagtttctgcacccaactgaacagggcgcttacaggcatagcagttgaacaagacaagaatacccaagaggtct
ttgcccaggtgaaacaaatttataagactcctccgatcaaggactttggagggttcaacttctcccagatacttcccgacccgagcaagccct
ccaagagatcgtttatagaagatctcctctttaacaaggtcacgttggctgatgccggctttattaaacaatacggtgactgtctcggagatatc
gcggctagagacctgatatgtgcacagaaatttaacgggctcaccgtattgccaccgctgctgacggatgaaatgatcgcccaatacacct
ccgcgttgttggccgggaccattacttctggttggacatttggtgcaggagccgcacttcagataccatttgctatgcaaatggcgtatcgatt
caacgggattggtgttacgcagaatgtcctctatgagaaccagaaactgatagcgaatcagttcaacagcgctattggcaagatccaagatt
ctttgtcatcaaccgcgagtgccctgggtaaactgcaagatgtagtcaaccagaacgcacaagcccttaatacccttgtcaagcagctctcat
ccaactttggtgctatttcttctgttctgaatgatattctcagtcgactggacaaggtagaagcagaggttcagatagatcgcctcattactggg
cgccttcagtcacttcagacttatgttacccaacaactcattagggcagccgaaatccgagcttcagcgaatctcgccgctactaagatgagc
gagtgcgtacttggtcaatccaagagagtagatttctgtgggaagggatatcacctgatgtctttcccacagagcgcgccacacggtgtagt
attcttgcatgttacatacgttccagcacaagagaagaactttactacagcaccggcaatctgccatgatgggaaggcacactttccgaggg
aggggagtctttgtatccaatggcacccactggtttgttactcaaagaaatttctatgagccacagatcattactacggacaacacctttgtaagc
gggaactgtgacgtagtcataggcatagtaaataataccgtttacgatccactgcagccggagctcgattcattcaaagaggaactggacaa
atacttcaagaaccacacgtcacctgacgttgaccttggtgatatttctggcataaacgcctctgttgtgaatatccagaaggagatagacag
actgaacgaggtggcaaagaatctgaacgaatcattgatcgatttgcaagagttgggaaagtacgaacagtatatataaagtggccgtggtata
tatggctagggttcattgctggacttatagcaattgtgatggtaacgatcatgttgtgttgcatgacttcctgctgcagttgcctcaaaggatgtt
gttcctgtggatcatgctgtaagtttgatgaagatgactccgaacccgtgcttaaaggagtgaagttgcactatacttaa

Fig. 96 atgtttgtctttctcgtacttctgcctctggtcagcagccaatgtgtgaacctcacaaccaggactcaattgccgccagcgtatacgaacagctt
cacgcgcggcgtttattatccggataaggtattccgcagcagtgtgcttcatagtacacaggacctattcttgccgttcttctcaaacgtgacat
ggttccatgccattagtggcacaaacgggacaaagcggttcgacaacccggttcttccctttaatgacggagtatactttgcaagcacggag
aagagcaacatcattagagggtggatctttgggaccacattggattccaagacgcagtccctgctgatagtcaacaacgctaccaacgtcgt
catcaaggtttgtgaattccaattctgcaacgatccgtttctgggagtttatcacaagaacaatataatcttggatggagagtgaatttcgcgttta
ctcatccgcaaataattgtaccttcgagtacgtgtcccagcctttcctcatggacttggagggtaagcagggaaactttaagaatctgagaga
atttgtctttaagaacattgacgggtacttcaagatatactcaaagcatacacccattaacctggtgagggatttgccgcagggattctcagca
ctggagccactcgttgatctgccgataggggataaatatcacgcggttccaaactcttcttgctttgcaccgctcttaccttactccaggagactc
ttcctctgggtggacggctggagcggctgcttattacgtcgggtacttgcagccgcggaccttccttctgaaatacaatgagaacggtacaat
tactgacgctgtggattgcgccctggatccgctgtctgagacgaaatgcacgcttaagtcatttacggtcgagaagggaatctatcagacat
ccaactttcgagtgcagcccacagaatccatagttcgattccctaacatcactaatttgtgtccatttggtgaagtgtttaacgcgaccaggttc
gccagcgtttatgcatggaatagaaagcggatcagtaattgcgtggccgattattctgtcctgtataattcagcatccttctctactttcaagtgtt
atggtgtttcaccaaccaaattgaacgatctctgcttcactaatgtttatgcagacagctttgtgatacgaggagatgaggtcagacagattgct
cccgggcaaacgggaaagattgctgattataactacaagctgcctgacgactttacgggctgtgtcatagcgtggaacagcaataacctcg
atagtaaggtaggcggtaattacaactacctgtatagactgtttcggaagtccaatctgaagcctttcgaacgcgatattagtaccgagatcta
tcaggcaggttccacaccttgcaatggagtggagggctttaattgctatttccctctgcaatcctacggattccaaccaacctatggcgttggc
taccagccttatcgggtggtcgtgctttcctttgaacttcttcacgcacccgctactgtatgtggccctaagaagagcactaaccttgtgaaga
acaaatgcgtcaatttcaactttaatgggctgaccggaaccggagtcctcacagagagcaacaagaaattccttccgtttcagcagttcggta
gggatatagatgacacgactgatgcggtccgggatcctcaaacgcttgagattcttgacatcacgccgtgcagctttggtggagttagtgta
attactccggggtaccaatactagcaaccaagttgccgtactttatcaaggtgtaaactgcactgaagtaccggtcgccattcatgcagaccag
ctcacaccaacgtggagggtttattccactggatccaatgtctttcaaacaagagcgggctgtttgattggagcggaacatgttaacaacagt
tacgagtgtgacatacctataggagctggcatctgtgcgagctaccagacacaaaccaactctcatagacgggcacgctccgtggcatctc
agtctatcatagcgtatacgatgagtttgggagcagagaattctgttgcatactctaacaatagtatcgccattccgattaactttaccatctcag
taacgaccgaaatacttcccgtctctatgactaagacaagtgtggactgcaccatgtacatttgcggtgactctaccgagtgctctaatttgcta
ttgcaatatgggtcattctgtactcagctgaatagggccttgactgggatagccgtcgaacaagacaagaatacgcaggaggtattcgccca
agtaaagcaaatatataagacacctcccatcaaagactttggagggttcaatttcagtcagatcctacccgatccaagtaagccatcaaaga
ggagcttcatcgaggatctgctattcaataaggttaccctcgctgacgctggcttcatcaagcagtatggagattgcctcggcgacatagca
gcacgagatcttatttgtgcacagaaatttaatggactcaccgttctcccacctctcctcacagacgaaatgatcgcacagtacacttctgccc
tcctcgccgggacgattactagcggctggacatttggcgctggtgctgctctgcagattccatttgctatgcagatggcttatcgctttaacgg
gatcggagtcacgcagaatgttctttacgagaaccagaaacttattgcgaaccagttcaactctgcgattgggaagatacaggatagcctttc
ctctactgcctctgcacttggtaagttgcaagacgttgtgaaccagaatgctcaagcattgaacacactggtgaagcagcttagttctaacttc
ggtgctatcagtagtgttctcaatgatatcctggctcggctcgacaaggtggaggccgaagtacaaatcgatagactcataaccggaagact
gcaatccttgcagacatacgttacccagcaacttatacgggccgccgaaatacgagcgtcagcaaacttggccgccaccaagatgtctga
atgcgtcttgggccaaagcaagcgagtggacttctgcggtaaaggttatcatttgatgtcattccctcaatccgctcctcatggagtggtgtttc
ttcatgttacttacgtgcctgcacaagagaagaatttcaccactgctccagccatttgtcatgatgggaaagcccatttcccaagggaaggag
tattcgtctcaaatggaacacattggttcgtaacacagagaaacttctacgaaccacaaatcataacaacccacaatacgttcgtttcaggga
actgcgatgtcgtaatcggaatagtaaacaatacggtctatgacccattgcaaccagagcttgactctttcaaagaagagttggataagtactt
taagaatcatacgtctccggacgtagatcttggcgatataagtggcattaatgcttctgttgtgaatatacagaaagaaatcgacagacttaac
gaggtcgcgaagaatctgaacgagtcattgatagaccttcaggaattgggcaagtatgaacagtacattaaatggccgtggtacatatggct
agggtttatagcaggccttatagcaatcgtcatggttaccatcatgctttgctgtatgaccagttgctgctcatgcctgaagggttgttgttcctg
cggatcttgctgtaagttcgatgaagacgattctgagcctgtcctcaaaggagtaaagctccattacacctaa

Fig. 97 atgtttgtcttcttggtccttctgccgcttgtttcttcacaatgtgtgcgcgtgcagcccacggaatcaattgtgcggtttcccaatattacaaactt
gtgccctttcggcgaggtcttcaatgcaacgcgctttgcgtcagtttacgcctggaataggaagaggatatcaaactgcgtggctgactattc
tgtgctttacaactctgctagtttcagtacctttaagtgttacggtgtgagtccgacgaagctcaatgatctttgtttcactaatgtatacgcggac
agtttcgttatacgaggagacgaggtccggcaaatcgcacccggccaaacgggaaagattgctgactacaactacaaattgcccgatgac
tttacgggatgcgtcattgcatggaattctaataatctggatagcaaagtaggtggaaactataattatctctaccggctcttccgaaagagtaa
tctcaaaccgtttgaaagagatattagcacggaaatatatcaagccggctccacaccatgtaatggagttgaaggctttaattgttatttcccgt
tgcaaagttacggatttcagcccacgaacggtgtgggttatcaaccgtatcgggtcgtagttctcagcttcgagctgcttcatgcgcccgcga
ctgtttgcggtcctaagaagtcaaccaatctcgtaaagaacaagtgtgtgaacttcggatctggatcaggttcacgcgttcagcctacagagt
caattgtgcgatttcctaacatcactaacctgtgcccgtttggagaagtatttaatgcgactcgcttcgctagtgtctatgcgtggaatcgaaag
cggatctcaaactgtgtggcagattattccgtcctgtataatagtgccagcttctcaacgtttaaatgctacggagttagcccaacgaagctga
acgacttgtgctttacgaacgtgtatgccgattccttcgtcatccgcggagacgaagttcgccaaatcgcaccaggtcaaacgggtaatata
gcggactacaactacaagctgcccgacgatttcactgggtgcgtgatcgcgtggaatagtaacaacttggactccaaagtgggtggcaact
acaactatctgtataggctgtttcgaaagtccaacttgaaaccgtttgaaagggatattagtacagagatctatcaagctggtagcacaccctg
caacggtgttaaaggctttaactgctactttcctttgcagagctatggatttcagcctacttatggagtcggttaccaaccttatcgcgtcgtagt
actgagtttcgaactccttcatgcacccgcaactgtgtgcgggccaaagaagtctaccaatttggtcaagaataagtgtgtaaacttcggtagt
ggttctggtagtcgagtgcagcccacagaatccatagttcgattccctaacatcactaatttgtgtccatttggtgaagtgtttaacgcgaccag
gttcgccagcgtttatgcatggaatagaaagcggatcagtaattgcgtggccgattattctgtcctgtataattcagcatccttctctactttcaa
gtgttatggtgtttcaccaaccaaattgaacgatctctgcttcactaatgtttatgcagacagctttgtgatacgaggagatgaggtcagacaga
ttgctcccgggcaaacgggaaagattgctgattataactacaagctgcctgacgactttacgggctgtgtcatagcgtggaacagcaataac
ctcgatagtaaggtaggcggtaattacaactaccggtatagactgtttcggaagtccaatctgaagcctttcgaacgcgatattagtaccgag
atctatcaggcaggttccacaccttgcaatggagtggagggctttaattgctatttccctctgcaatcctacggattccaaccaacctatggcgt
tggctaccagccttatcgggtggtcgtgctttcctttgaacttcttcacgcacccgctactgtatgtggccctaagaagagcactaaccttgtga
agaacaaatgcgtcaatttctaa

Fig. 98

MFVFLVLLPLVSSQCVRVQPTESIVRFPNITNLCPFGEVFNATRFASVYAWNRKRISNCV
ADYSVLYNSASFSTFKCYGVSPTKLNDLCFTNVYADSFVIRGDEVRQIAPGQTGKIADY
NYKLPDDFTGCVIAWNSNNLDSKVGGNYNYLYRLFRKSNLKPFERDISTEIYQAGSTPC
NGVEGFNCYFPLQSYGFQPTNGVGYQPYRVVVLSFELLHAPATVCGPKKSTNLVKNKC
VNFGSGSGSRVQPTESIVRFPNITNLCPFGEVFNATRFASVYAWNRKRISNCVADYSVLY
NSASFSTFKCYGVSPTKLNDLCFTNVYADSFVIRGDEVRQIAPGQTGNIADYNYKLPDD
FTGCVIAWNSNNLDSKVGGNYNYLYRLFRKSNLKPFERDISTEIYQAGSTPCNGVKGFN
CYFPLQSYGFQPTYGVGYQPYRVVVLSFELLHAPATVCGPKKSTNLVKNKCVNFGSGS
GSRVQPTESIVRFPNITNLCPFGEVFNATRFASVYAWNRKRISNCVADYSVLYNSASFST
FKCYGVSPTKLNDLCFTNVYADSFVIRGDEVRQIAPGQTGKIADYNYKLPDDFTGCVIA
WNSNNLDSKVGGNYNYRYRLFRKSNLKPFERDISTEIYQAGSTPCNGVEGFNCYFPLQS
YGFQPTYGVGYQPYRVVVLSFELLHAPATVCGPKKSTNLVKNKCVNF

Fig. 99 atgtttgtcttcttggtccttctgccgcttgtttcttcacaatgtgtgcgcgtgcagcccacggaatcaattgtgcggtttcccaatattacaaactt
gtgccctttcggcgaggtcttcaatgcaacgcgctttgcgtcagtttacgcctggaataggaagaggatatcaaactgcgtggctgactattc
tgtgctttacaactctgctagtttcagtacctttaagtgttacggtgtgagtccgacgaagctcaatgatctttgtttcactaatgtatacgcggac
agtttcgttatacgaggagacgaggtccggcaaatcgcacccggccaaacgggaaagattgctgactacaactacaaattgcccgatgac
tttacgggatgcgtcattgcatggaattctaataatctggatagcaaagtaggtggaaactataattatctctaccggctcttccgaaagagtaa
tctcaaaccgtttgaaagagatattagcacggaaatatatcaagccggctccacaccatgtaatggagttgaaggctttaattgttatttcccgt
tgcaaagttacggatttcagcccacgaacggtgtgggttatcaaccgtatcgggtcgtagttctcagcttcgagctgcttcatgcgcccgcga
ctgtttgcggtcctaagaagtcaaccaatctcgtaaagaacaagtgtgtgaacttcggatctggatcaggttcacgcgttcagcctacagagt
caattgtgcgatttcctaacatcactaacctgtgcccgtttggagaagtatttaatgcgactcgcttcgctagtgtctatgcgtggaatcgaaag
cggatctcaaactgtgtggcagattattccgtcctgtataatagtgccagcttctcaacgtttaaatgctacggagttagcccaacgaagctga
acgacttgtgctttacgaacgtgtatgccgattccttcgtcatccgcgcgagacgaagttcgccaaatcgcaccaggtcaaacgggtaatata
gcggactacaactacaagctgcccgacgatttcactgggtgcgtgatcgcgtggaatagtaacaacttggactccaaagtgggtggcaact
acaactatctgtataggctgtttcgaaagtccaacttgaaaccgtttgaaagggatattagtacagagatctatcaagctggtagcacaccctg
caacggtgttaaaggctttaactgctactttcctttgcagagctatggatttcagcctacttatggagtcggttaccaaccttatcgcgtcgtagt
actgagtttcgaactccttcatgcacccgcaactgtgtgcgggccaaagaagtctaccaatttggtcaagaataagtgtgtaaacttcggtagt
ggttctggtagtcgagtgcagcccacagaatccatagttcgattccctaacatcactaatttgtgtccatttggtgaagtgtttaacgcgaccag
gttcgccagcgtttatgcatggaatagaaagcggatcagtaattgcgtggccgattattctgtcctgtataattcagcatccttctctactttcaa
gtgttatggtgtttcaccaaccaaattgaacgatctctgcttcactaatgtttatgcagacagctttgtgatacgaggagatgaggtcagacaga
ttgctcccgggcaaacgggaaagattgctgattataactacaagctgcctgacgacttacgggctgtgtcatagcgtggaacagcaataac
ctcgatagtaaggtaggcggtaattacaactaccggtatagactgtttcggaagtccaatctgaagcctttcgaacgcgatattagtaccgag
atctatcaggcaggtccacaccttgcaatggagtggagggctttaattgctatttccctctgcaatcctacggattccaaccaacctatggcgt
tggctaccagccttatcgggtggtcgtgctttcctttgaacttcttcacgcacccgctactgtatgtggccctaagaagagcactaaccttgtga
agaacaaatgcgtcaatttcggatcaggaagtggatcaggttatatccctgaagcgccaagagacggacaggcttatgtcagaaaggatg
gtgaatgggtcttgctttcgacgttcctataa

Fig. 100

MFVFLVLLPLVSSQCVRVQPTESIVRFPNITNLCPFGEVFNATRFASVYAWNRKRISNCV
ADYSVLYNSASFSTFKCYGVSPTKLNDLCFTNVYADSFVIRGDEVRQIAPGQTGKIADY
NYKLPDDFTGCVIAWNSNNLDSKVGGNYNYLYRLFRKSNLKPFERDISTEIYQAGSTPC
NGVEGFNCYFPLQSYGFQPTNGVGYQPYRVVVLSFELLHAPATVCGPKKSTNLVKNKC
VNFGSGSGSRVQPTESIVRFPNITNLCPFGEVFNATRFASVYAWNRKRISNCVADYSVLY
NSASFSTFKCYGVSPTKLNDLCFTNVYADSFVIRGDEVRQIAPGQTGNIADYNYKLPDD
FTGCVIAWNSNNLDSKVGGNYNYLYRLFRKSNLKPFERDISTEIYQAGSTPCNGVKGFN
CYFPLQSYGFQPTYGVGYQPYRVVVLSFELLHAPATVCGPKKSTNLVKNKCVNFGSGS
GSRVQPTESIVRFPNITNLCPFGEVFNATRFASVYAWNRKRISNCVADYSVLYNSASFST
FKCYGVSPTKLNDLCFTNVYADSFVIRGDEVRQIAPGQTGKIADYNYKLPDDFTGCVIA
WNSNNLDSKVGGNYNYRYRLFRKSNLKPFERDISTEIYQAGSTPCNGVEGFNCYFPLQS
YGFQPTYGVGYQPYRVVVLSFELLHAPATVCGPKKSTNLVKNKCVNFGSGSGSGYIPE
APRDGQAYVRKDGEWVLLSTFL

Fig. 101 atgtttgtcttcttggtccttctgccgcttgtttcttcacaatgtgtgcgcgtgcagcccacggaatcaattgtgcggtttcccaatattacaaactt
gtgccctttcggcgaggtcttcaatgcaacgcgctttgcgtcagtttacgcctggaataggaagaggatatcaaactgcgtggctgactattc
tgtgctttacaactctgctagtttcagtacctttaagtgttacggtgtgagtccgacgaagctcaatgatctttgtttcactaatgtatacgcggac
agtttcgttatacgaggagacgaggtccggcaaatcgcacccggccaaacgggaaagattgctgactacaactacaaattgcccgatgac
tttacgggatgcgtcattgcatggaattctaataatctggatagcaaagtaggtggaaactataattatctctaccggctcttccgaaagagtaa
tctcaaaccgtttgaaagagatattagcacggaaatatatcaagccggctccacaccatgtaatggagttgaaggctttaattgttatttcccgt
tgcaaagttacggatttcagcccacgaacggtgtgggttatcaaccgtatcgggtcgtagttctcagcttcgagctgcttcatgcgcccgcga
ctgtttgcggtcctaagaagtcaaccaatctcgtaaagaacaagtgtgtgaacttcggatctggatcaggttcaggagctaccaatttcagtct
actaaagcaagcgggtgatgttgaggagaatcccggacctatgttcgtgtttcttgtgttgttgccactggtttcatcccaatgtgtgcgcgttc
agcctacagagtcaattgtgcgatttcctaacatcactaacctgtgcccgtttggagaagtatttaatgcgactcgcttcgctagtgtctatgcgt
ggaatcgaaagcggatctcaaactgtgtggcagattattccgtcctgtataatagtgccagcttctcaacgtttaaatgctacggagttagccc
aacgaagctgaacgacttgtgctttacgaacgtgtatgccgattccttcgtcatccgcgggagacgaagttcgccaaatcgcaccaggtcaaa
cgggtaatatagcggactacaactacaagctgcccgacgatttcactgggtgcgtgatcgcgtggaatagtaacaacttggactccaaagt
gggtggcaactacaactatctgtataggctgtttcgaaagtccaacttgaaaccgtttgaaagggatattagtacagagatctatcaagctggt
agcacaccctgcaacggtgttaaaggctttaactgctactttcctttgcagagctatggatttcagcctacttatggagtcggttaccaaccttat
cgcgtcgtagtactgagtttcgaactccttcatgcacccgcaactgtgtgcgggccaaagaagtctaccaatttggtcaagaataagtgtgta
aacttcggtagtggttctggtagtggagaaggtcgtggttctctacttacgtgcggagatgttgaggagaatccaggacctatgtttgtctttct
cgtacttctgcctctggtcagcagccaatgtgtgcgagtgcagcccacagaatccatagttcgattccctaacatcactaatttgtgtccatttg
gtgaagtgtttaacgcgaccaggttcgccagcgtttatgcatggaatagaaagcggatcagtaattgcgtggccgattattctgtcctgtataa
ttcagcatccttctctactttcaagtgttatggtgtttcaccaaccaaattgaacgatctctgcttcactaatgtttatgcagacagctttgtgatac
gaggagatgaggtcagacagattgctcccgggcaaacgggaaagattgctgattataactacaagctgcctgacgactttacgggctgtgt
catagcgtggaacagcaataacctcgatagtaaggtaggcggtaattacaactaccggtatagactgtttcggaagtccaatctgaagccttt
cgaacgcgatattagtaccgagatctatcaggcaggttccacaccttgcaatggagtggagggctttaattgctatttccctctgcaatcctac
ggattccaaccaacctatggcgttggctaccagccttatcgggtggtcgtgctttcctttgaacttcttcacgcacccgctactgtatgtggccc
taagaagagcactaaccttgtgaagaacaaatgcgtcaatttctaa

Fig. 102

MFVFLVLLPLVSSQCVRVQPTESIVRFPNITNLCPFGEVFNATRFASVYAWNRKRISNCV
ADYSVLYNSASFSTFKCYGVSPTKLNDLCFTNVYADSFVIRGDEVRQIAPGQTGKIADY
NYKLPDDFTGCVIAWNSNNLDSKVGGNYNYLYRLFRKSNLKPFERDISTEIYQAGSTPC
NGVEGFNCYFPLQSYGFQPTNGVGYQPYRVVVLSFELLHAPATVCGPKKSTNLVKNKC
VNFGSGSGSGATNFSLLKQAGDVEENPGPMFVFLVLLPLVSSQCVRVQPTESIVRFPNIT
NLCPFGEVFNATRFASVYAWNRKRISNCVADYSVLYNSASFSTFKCYGVSPTKLNDLCF
TNVYADSFVIRGDEVRQIAPGQTGNIADYNYKLPDDFTGCVIAWNSNNLDSKVGGNYN
YLYRLFRKSNLKPFERDISTEIYQAGSTPCNGVKGFNCYFPLQSYGFQPTYGVGYQPYR
VVVLSFELLHAPATVCGPKKSTNLVKNKCVNFGSGSGSGEGRGSLLTCGDVEENPGPM
FVFLVLLPLVSSQCVRVQPTESIVRFPNITNLCPFGEVFNATRFASVYAWNRKRISNCVA
DYSVLYNSASFSTFKCYGVSPTKLNDLCFTNVYADSFVIRGDEVRQIAPGQTGKIADYN
YKLPDDFTGCVIAWNSNNLDSKVGGNYNYRYRLFRKSNLKPFERDISTEIYQAGSTPCN
GVEGFNCYFPLQSYGFQPTYGVGYQPYRVVVLSFELLHAPATVCGPKKSTNLVKNKCV
NF

Fig. 103 atgtttgtcttcttggtccttctgccgcttgtttcttcacaatgtgtgcgcgtgcagcccacggaatcaattgtgcggtttcccaatattacaaactt
gtgccctttcggcgaggtcttcaatgcaacgcgctttgcgtcagtttacgcctggaataggaagaggatatcaaactgcgtggctgactattc
tgtgctttacaactctgctagtttcagtacctttaagtgttacggtgtgagtccgacgaagctcaatgatctttgtttcactaatgtatacgcggac
agtttcgttatacgaggagacgaggtccggcaaatcgcacccggccaaacgggaaagattgctgactacaactacaaattgcccgatgac
tttacgggatgcgtcattgcatggaattctaataatctggatagcaaagtaggtggaaactataattatctctaccggctcttccgaaagagtaa
tctcaaaccgtttgaaagagatattagcacggaaatatatcaagccggctccacaccatgtaatggagttgaaggctttaattgttatttcccgt
tgcaaagttacggatttcagcccacgaacggtgtgggttatcaaccgtatcgggtcgtagttctcagcttcgagctgcttcatgcgcccgcga
ctgtttgcggtcctaagaagtcaaccaatctcgtaaagaacaagtgtgtgaacttcggatctggatcaggttcaggttacattccagaagcac
cacgagacggtcaggcatacgtgcgtaaggacggtgagtgggtgctactaagtacattcttaggttcgggttcggggttctggagctaccaat
ttcagtctactaaagcaagcgggtgatgttgaggagaatcccggacctatgttcgtgtttcttgtgttgttgccactggtttcatcccaatgtgtg
cgcgttcagcctacagagtcaattgtgcgatttcctaacatcactaacctgtgcccgtttggagaagtatttaatgcgactcgcttcgctagtgt
ctatgcgtggaatcgaaagcggatctcaaactgtgtggcagattattccgtcctgtataatagtgccagcttctcaacgtttaaatgctacgga
gttagcccaacgaagctgaacgacttgtgctttacgaacgtgtatgccgattccttcgtcatccgcgggagacgaagttcgccaaatcgcacc
aggtcaaacgggtaatatagcggactacaactacaagctgcccgacgatttcactgggtgcgtgatcgcgtggaatagtaacaacttggac
tccaaagtgggtggcaactacaactatctgtataggctgtttcgaaagtccaacttgaaaccgtttgaaagggatattagtacagagatctatc
aagctggtagcacaccctgcaacggtgttaaaggctttaactgctactttcctttgcagagctatggatttcagcctacttatggagtcggttac
caaccttatcgcgtcgtagtactgagtttcgaactccttcatgcacccgcaactgtgtgcgggccaaagaagtctaccaatttggtcaagaat
aagtgtgtaaacttcggtagtggttctggtagtggatatataccggaggctcctcgtgatggacaagcctatgtacgtaaagatggagaatgg
gtattattgagtacgttcttaggatctggatccggatcaggagaaggtcgtggttctctacttacgtgcggagatgttgaggagaatccagga
cctatgtttgtctttctcgtacttctgcctctggtcagcagccaatgtgtgcgagtgcagcccacagaatccatagttcgattccctaacatcact
aatttgtgtccatttggtgaagtgtttaacgcgaccaggttcgccagcgtttatgcatggaatagaaagcggatcagtaattgcgtggccgatt
attctgtcctgtataattcagcatccttctctactttcaagtgttatggtgtttcaccaaccaaattgaacgatctctgcttcactaatgtttatgcag
acagctttgtgatacgaggagatgaggtcagacagattgctcccgggcaaacgggaaagattgctgattataactacaagctgcctgacga
ctttacgggctgtgtcatagcgtggaacagcaataacctcgatagtaaggtaggcggtaattacaactaccggtatagactgtttcggaagtc
caatctgaagcctttcgaacgcgatattagtaccgagatctatcaggcaggtccacaccttgcaatggagtggagggctttaattgctatttc
cctctgcaatcctacggattccaaccaacctatggcgttggctaccagccttatcgggtggtcgtgctttcctttgaacttcttcacgcacccgc
tactgtatgtggccctaagaagagcactaaccttgtgaagaacaaatgcgtcaatttcggatcaggaagtggatcaggttatatccctgaagc
gccaagagacggacaggcttatgtcagaaaggatggtgaatgggtcttgctttcgacgttcctataa

Fig. 104

MFVFLVLLPLVSSQCVRVQPTESIVRFPNITNLCPFGEVFNATRFASVYAWNRKRISNCV
ADYSVLYNSASFSTFKCYGVSPTKLNDLCFTNVYADSFVIRGDEVRQIAPGQTGKIADY
NYKLPDDFTGCVIAWNSNNLDSKVGGNYNYLYRLFRKSNLKPFERDISTEIYQAGSTPC
NGVEGFNCYFPLQSYGFQPTNGVGYQPYRVVVLSFELLHAPATVCGPKKSTNLVKNKC
VNFGSGSGSGYIPEAPRDGQAYVRKDGEWVLLSTFLGSGSGSGATNFSLLKQAGDVEE
NPGPMFVFLVLLPLVSSQCVRVQPTESIVRFPNITNLCPFGEVFNATRFASVYAWNRKRI
SNCVADYSVLYNSASFSTFKCYGVSPTKLNDLCFTNVYADSFVIRGDEVRQIAPGQTGN
IADYNYKLPDDFTGCVIAWNSNNLDSKVGGNYNYLYRLFRKSNLKPFERDISTEIYQAG
STPCNGVKGFNCYFPLQSYGFQPTYGVGYQPYRVVVLSFELLHAPATVCGPKKSTNLV
KNKCVNFGSGSGSGYIPEAPRDGQAYVRKDGEWVLLSTFLGSGSGSGEGRGSLLTCGD
VEENPGPMFVFLVLLPLVSSQCVRVQPTESIVRFPNITNLCPFGEVFNATRFASVYAWNR
KRISNCVADYSVLYNSASFSTFKCYGVSPTKLNDLCFTNVYADSFVIRGDEVRQIAPGQT
GKIADYNYKLPDDFTGCVIAWNSNNLDSKVGGNYNYRYRLFRKSNLKPFERDISTEIYQ
AGSTPCNGVEGFNCYFPLQSYGFQPTYGVGYQPYRVVVLSFELLHAPATVCGPKKSTN
LVKNKCVNFGSGSGSGYIPEAPRDGQAYVRKDGEWVLLSTFL

Fig. 105 atgtttgtcttcttggtccttctgccgcttgtttcttcacaatgtgtgcgcgtgcagcccacggaatcaattgtgcggtttcccaatattacaaactt
gtgccctttcggcgaggtcttcaatgcaacgcgctttgcgtcagtttacgcctggaataggaagaggatatcaaactgcgtggctgactattc
tgtgctttacaactctgctagtttcagtacctttaagtgttacggtgtgagtccgacgaagctcaatgatctttgtttcactaatgtatacgcggac
agtttcgttatacgaggagacgaggtccggcaaatcgcacccggccaaacgggaaagattgctgactacaactacaaattgcccgatgac
tttacgggatgcgtcattgcatggaattctaataatctggatagcaaagtaggtggaaactataattatctctaccggctcttccgaaagagtaa
tctcaaaccgtttgaaagagatattagcacggaaatatatcaagccggctccacaccatgtaatggagttgaaggctttaattgttatttcccgt
tgcaaagttacggatttcagcccacgaacggtgtgggttatcaaccgtatcgggtcgtagttctcagcttcgagctgcttcatgcgcccgcga
ctgtttgcggtcctaagaagtcaaccaatctcgtaaagaacaagtgtgtgaacttcggatctggatcaggttcacgcgttcagcctacagagt
caattgtgcgatttcctaacatcactaacctgtgcccgtttggagaagtatttaatgcgactcgcttcgctagtgtctatgcgtggaatcgaaag
cggatctcaaactgtgtggcagattattccgtcctgtataatagtgccagcttctcaacgtttaaatgctacggagttagcccaacgaagctga
acgacttgtgctttacgaacgtgtatgccgattccttcgtcatccgcgcgagacgaagttcgccaaatcgcaccaggtcaaacgggtaatata
gcggactacaactacaagctgcccgacgatttcactgggtgcgtgatcgcgtggaatagtaacaacttggactccaaagtgggtggcaact
acaactatctgtataggctgtttcgaaagtccaacttgaaaccgtttgaaagggatattagtacagagatctatcaagctggtagcacaccctg
caacggtgttaaaggctttaactgctactttcctttgcagagctatggatttcagcctacttatggagtcggttaccaaccttatcgcgtcgtagt
actgagtttcgaactccttcatgcacccgcaactgtgtgcgggccaaagaagtctaccaatttggtcaagaataagtgtgtaaacttcggtagt
ggttctggtagtcgagtgcagcccacagaatccatagttcgattccctaacatcactaatttgtgtccatttggtgaagtgtttaacgcgaccag
gttcgccagcgtttatgcatggaatagaaagcggatcagtaattgcgtggccgattattctgtcctgtataattcagcatccttctctactttcaa
gtgttatggtgtttcaccaaccaaattgaacgatctctgcttcactaatgtttatgcagacagctttgtgatacgaggagatgaggtcagacaga
ttgctcccgggcaaacgggaaagattgctgattataactacaagctgcctgacgactttacgggctgtgtcatagcgtggaacagcaataac
ctcgatagtaaggtaggcggtaattacaactaccggtatagactgtttcggaagtccaatctgaagcctttcgaacgcgatattagtaccgag
atctatcaggcaggttccacaccttgcaatggagtggagggctttaattgctatttccctctgcaatcctacggattccaaccaacctatggcgt
tggctaccagccttatcgggtggtcgtgctttcctttgaacttcttcacgcacccgctactgtatgtggccctaagaagagcactaaccttgtga
agaacaaatgcgtcaatttcggatcaggaagtggatcatggtacatatggctagggtttatagcaggccttatagcaatcgtcatggttaccat
catgctttgctgtatgaccagttgctgctcatgcctgaagggttgttgttcctgcggatcttgctgttaa

Fig. 106

MFVFLVLLPLVSSQCVRVQPTESIVRFPNITNLCPFGEVFNATRFASVYAWNRKRISNCV
ADYSVLYNSASFSTFKCYGVSPTKLNDLCFTNVYADSFVIRGDEVRQIAPGQTGKIADY
NYKLPDDFTGCVIAWNSNNLDSKVGGNYNYLYRLFRKSNLKPFERDISTEIYQAGSTPC
NGVEGFNCYFPLQSYGFQPTNGVGYQPYRVVVLSFELLHAPATVCGPKKSTNLVKNKC
VNFGSGSGSRVQPTESIVRFPNITNLCPFGEVFNATRFASVYAWNRKRISNCVADYSVLY
NSASFSTFKCYGVSPTKLNDLCFTNVYADSFVIRGDEVRQIAPGQTGNIADYNYKLPDD
FTGCVIAWNSNNLDSKVGGNYNYLYRLFRKSNLKPFERDISTEIYQAGSTPCNGVKGFN
CYFPLQSYGFQPTYGVGYQPYRVVVLSFELLHAPATVCGPKKSTNLVKNKCVNFGSGS
GSRVQPTESIVRFPNITNLCPFGEVFNATRFASVYAWNRKRISNCVADYSVLYNSASFST
FKCYGVSPTKLNDLCFTNVYADSFVIRGDEVRQIAPGQTGKIADYNYKLPDDFTGCVIA
WNSNNLDSKVGGNYNYRYRLFRKSNLKPFERDISTEIYQAGSTPCNGVEGFNCYFPLQS
YGFQPTYGVGYQPYRVVVLSFELLHAPATVCGPKKSTNLVKNKCVNFGSGSGSWYIWL
GFIAGLIAIVMVTIMLCCMTSCCSCLKGCCSCGSCC

Fig. 107 atgtttgtcttcttggtccttctgccgcttgtttcttcacaatgtgtgcgcgtgcagcccacggaatcaattgtgcggtttcccaatattacaaactt
gtgcccttcggcgaggtcttcaatgcaacgcgctttgcgtcagtttacgcctggaataggaagaggatatcaaactgcgtggctgactattc
tgtgctttacaactctgctagtttcagtacctttaagtgttacggtgtgagtccgacgaagctcaatgatctttgtttcactaatgtatacgcggac
agtttcgttatacgaggagacgaggtccggcaaatcgcacccggccaaacgggaaagattgctgactacaactacaaattgcccgatgac
tttacgggatgcgtcattgcatggaattctaataatctggatagcaaagtaggtggaaactataattatctctaccggctcttccgaaagagtaa
tctcaaaccgtttgaaagagatattagcacggaaatatatcaagccggctccacaccatgtaatggagttgaaggctttaattgttatttcccgt
tgcaaagttacggatttcagcccacgaacggtgtgggttatcaaccgtatcgggtcgtagttctcagcttcgagctgcttcatgcgcccgcga
ctgtttgcggtcctaagaagtcaaccaatctcgtaaagaacaagtgtgtgaacttcggatctggatcaggttcatggtacatctggctcggctt
tatagctggcctgatcgccattgtgatggtgactattatgttgtgttgcatgactagctgctgttcatgtcttaagggatgctgcagctgcggtag
ctgctgtggttcgggttcgggttctggagctaccaatttcagtctactaaagcaagcgggtgatgttgaggagaatcccggacctatgttcgt
gtttcttgtgttgttgccactggtttcatcccaatgtgtgcgcgcgttcagcctacagagtcaattgtgcgatttcctaacatcactaacctgtgcccg
tttggagaagtatttaatgcgactcgcttcgctagtgtctatgcgtggaatcgaaagcggatctcaaactgtgtggcagattattccgtcctgta
taatagtgccagcttctcaacgtttaaatgctacggagttagcccaacgaagctgaacgacttgtgctttacgaacgtgtatgccgattccttc
gtcatccgcggagacgaagttcgccaaatcgcaccaggtcaaacgggtaatatagcggactacaactacaagctgcccgacgatttcact
gggtgcgtgatcgcgtggaatagtaacaacttggactccaaagtgggtggcaactacaactatctgtataggctgtttcgaaagtccaacttg
aaaccgtttgaaagggatattagtacagagatctatcaagctggtagcacaccctgcaacggtgttaaaggctttaactgctactttcctttgca
gagctatggatttcagcctacttatggagtcggttaccaaccttatcgcgtcgtagtactgagtttcgaactccttcatgcacccgcaactgtgt
gcgggccaaagaagtctaccaatttggtcaagaataagtgtgtaaacttcggtagtggttctggtagttggtatatatggctagggttcattgct
ggacttatagcaattgtgatggtaacgatcatgttgtgttgcatgacttcctgctgcagttgcctcaaaggatgttgttcctgtggatcatgctgt
ggatctggatccggatcaggagaaggtcgtggttctctacttacgtgcggagatgttgaggagaatccaggacctatgtttgtctttctcgtac
ttctgcctctggtcagcagccaatgtgtgcgagtgcagcccacagaatccatagttcgattccctaacatcactaatttgtgtccatttggtgaa
gtgtttaacgcgaccaggttcgccagcgtttatgcatggaatagaaagcggatcagtaattgcgtggccgattattctgtcctgtataattcag
catccttctctactttcaagtgttatggtgtttcaccaaccaaattgaacgatctctgcttcactaatgtttatgcagacagctttgtgatacgagga
gatgaggtcagacagattgctcccgggcaaacgggaaagattgctgattataactacaagctgcctgacgactttacgggctgtgtcatagc
gtggaacagcaataacctcgatagtaaggtaggcggtaattacaactaccggtatagactgtttcggaagtccaatctgaagcctttcgaac
gcgatattagtaccgagatctatcaggcaggttccacaccttgcaatggagtggagggctttaattgctatttccctctgcaatcctacggattc
caaccaacctatggcgttggctaccagccttatcgggtggtcgtgctttcctttgaacttcttcacgcacccgctactgtatgtggccctaaga
agagcactaaccttgtgaagaacaaatgcgtcaatttcggatcaggaagtggatcatggtacatatggctagggtttatagcaggccttatag
caatcgtcatggttaccatcatgctttgctgtatgaccagttgctgctcatgcctgaagggttgttgttcctgcggatcttgctgttaa

Fig. 108

MFVFLVLLPLVSSQCVRVQPTESIVRFPNITNLCPFGEVFNATRFASVYAWNRKRISNCV
ADYSVLYNSASFSTFKCYGVSPTKLNDLCFTNVYADSFVIRGDEVRQIAPGQTGKIADY
NYKLPDDFTGCVIAWNSNNLDSKVGGNYNYLYRLFRKSNLKPFERDISTEIYQAGSTPC
NGVEGFNCYFPLQSYGFQPTNGVGYQPYRVVVLSFELLHAPATVCGPKKSTNLVKNKC
VNFGSGSGSWYIWLGFIAGLIAIVMVTIMLCCMTSCCSCLKGCCSCGSCCGSGSGSGAT
NFSLLKQAGDVEENPGPMFVFLVLLPLVSSQCVRVQPTESIVRFPNITNLCPFGEVFNAT
RFASVYAWNRKRISNCVADYSVLYNSASFSTFKCYGVSPTKLNDLCFTNVYADSFVIRG
DEVRQIAPGQTGNIADYNYKLPDDFTGCVIAWNSNNLDSKVGGNYNYLYRLFRKSNLK
PFERDISTEIYQAGSTPCNGVKGFNCYFPLQSYGFQPTYGVGYQPYRVVVLSFELLHAPA
TVCGPKKSTNLVKNKCVNFGSGSGSWYIWLGFIAGLIAIVMVTIMLCCMTSCCSCLKGC
CSCGSCCGSGSGSGEGRGSLLTCGDVEENPGPMFVFLVLLPLVSSQCVRVQPTESIVRFP
NITNLCPFGEVFNATRFASVYAWNRKRISNCVADYSVLYNSASFSTFKCYGVSPTKLND
LCFTNVYADSFVIRGDEVRQIAPGQTGKIADYNYKLPDDFTGCVIAWNSNNLDSKVGG
NYNYRYRLFRKSNLKPFERDISTEIYQAGSTPCNGVEGFNCYFPLQSYGFQPTYGVGYQ
PYRVVVLSFELLHAPATVCGPKKSTNLVKNKCVNFGSGSGSWYIWLGFIAGLIAIVMVT
IMLCCMTSCCSCLKGCCSCGSCC

Fig. 109 atgtctctaaacggaccacagaatcagcgaaacgcaccacgcattacgtttggtggaccctcagattcaactggcagtaaccagaatggag
aacgcagtggagcgcgatctaaacaacgtcggcctcaaggtttacccaataatactgcgtcttggttcaccgctctcactcaacatggcaag
gaagaccttaaattccctcgaggacaaggcgttccaattaacaccaatagcagtccagatgaccaaattggctactaccgaagagctacca
gacgaattcgtggtggtgacggtaagatgaaagatctcagtccaagatggtatttctactacctaggaactgggccagaagctggacttccc
tatggtgctaacaaagacggcatcatatgggttgcaactgagggagccttgaatacacctaaagatcacattggcacccgcaatcctgctaa
caatgctgcaatcgtgctacaacttcctcaaggaacaacattgcctaaaggcttctacgcagaagggagcagaggcggcagtcaagcctct
tctcgttcctcatcacgtagtcgcaacagttcaagaaattcaactccaggcagcagtaaacgaacttctcctgctagaatggctggcaatggc
ggtgatgctgctcttgctttgctgctgcttgacagattgaaccagcttgagagcaagatgttcggtaaaggccaacaacaacaaggccaaac
tgtcactaagaaatctgctgctgaggcttctaagaagcctcggcagaaacgtactgccactaaagcatacaatgtaacacaagctttcggca
gacgtggtccagaacaaacccaaggaaactttggagaccaggaactaatcagacaaggaactgattacaaacattggccgcaaattgcac
aatttgctcccagcgcttcagcgttcttcggaatgtcgcgcattggcatggaagtcacaccttcgggaacgtggttgacctacacaggtgcc
atcaaattggatgacaaagatccaaatttcaaagatcaagtcatattgctgaataagcatattgacgcatacaagacattcccaccaacagag
cctaagaaggacaagaagaagaaggctgatgaaactcaagccttaccgcagagacagaagaaacagcaaactgtgactcttcttcctgct
gcagatttggatgatttctccaaacaattgcaacaatccatgagcagtgctgactcaactcaggcctaa

Fig. 110

MSLNGPQNQRNAPRITFGGPSDSTGSNQNGERSGARSKQRRPQGLPNNTASWFTALTQ
HGKEDLKFPRGQGVPINTNSSPDDQIGYYRRATRRIRGGDGKMKDLSPRWYFYYLGTG
PEAGLPYGANKDGIIWVATEGALNTPKDHIGTRNPANNAAIVLQLPQGTTLPKGFYAEG
SRGGSQASSRSSSRSRNSSRNSTPGSSKRTSPARMAGNGGDAALALLLLDRLNQLESKM
FGKGQQQQGQTVTKKSAAEASKKPRQKRTATKAYNVTQAFGRRGPEQTQGNFGDQEL
IRQGTDYKHWPQIAQFAPSASAFFGMSRIGMEVTPSGTWLTYTGAIKLDDKDPNFKDQ
VILLNKHIDAYKTFPPTEPKKDKKKKADETQALPQRQKKQQTVTLLPAADLDDFSKQL
QQSMSSADSTQA

Fig. 111 atgtctgataacggaccacagaatcagcgaaacgcaccacgcattacgtttggtggaccctcagattcaactggcagtaaccagaatggag
aacgcagtggagcgcgatctaaacaacgtcggcctcaaggtttacccaataatactgcgtcttggttcaccgctctcactcaacatggcaag
gaagaccttaaattccctcgaggacaaggcgttccaattaacaccaatagcagtccagatgaccaaattggctactaccgaagagctacca
gacgaattcgtggtggtgacggtaagatgaaagatctcagtccaagatggtatttctactacctaggaactgggccagaagctggacttccc
tatggtgctaacaaagacggcatcatatgggttgcaactgagggagccttgaatacacctaaagatcacattggcacccgcaatcctgctaa
caatgctgcaatcgtgctacaacttcctcaaggaacaacattgcctaaaggcttctacgcagaagggagcagaggcggcagtcaagcctct
tctcgttcctcatcacgtagtcgcaacagttcaagaaattcaactccaggcagcagtagaggaatctctcctgctagaatggctggcaatggc
ggtgatgctgctcttgctttgctgctgcttgacagattgaaccagcttgagagcaagatgtctggtaaaggccaacaacaacaaggccaaac
tgtcactaagaaatctgctgctgaggcttctaagaagcctcggcagaaacgtactgccactaaagcatacaatgtaacacaagctttcggca
gacgtggtccagaacaaacccaaggaaactttggagaccaggaactaatcagacaaggaactgattacaaacattggccgcaaattgcac
aatttgctcccagcgcttcagcgttcttcggaatgtcgcgcattggcatggaagtcacaccttcgggaacgtggttgacctacacaggtgcc
atcaaattggatgacaaagatccaaatttcaaagatcaagtcatattgctgaataagcatattgacgcatacaagacattcccaccaacagag
cctaagaaggacaagaagaagaaggctgatgaaactcaagccttaccgcagagacagaagaaacagcaaactgtgactcttcttcctgct
gcagatttggatgatttctccaaacaattgcaacaatccatgagcagtgctgactcaactcaggcctaa

Fig. 112

MSDNGPQNQRNAPRITFGGPSDSTGSNQNGERSGARSKQRRPQGLPNNTASWFTALTQ
HGKEDLKFPRGQGVPINTNSSPDDQIGYYRRATRRIRGGDGKMKDLSPRWYFYYLGTG
PEAGLPYGANKDGIIWVATEGALNTPKDHIGTRNPANNAAIVLQLPQGTTLPKGFYAEG
SRGGSQASSRSSSRSRNSSRNSTPGSSRGISPARMAGNGGDAALALLLLDRLNQLESKM
SGKGQQQQGQTVTKKSAAEASKKPRQKRTATKAYNVTQAFGRRGPEQTQGNFGDQEL
IRQGTDYKHWPQIAQFAPSASAFFGMSRIGMEVTPSGTWLTYTGAIKLDDKDPNFKDQ
VILLNKHIDAYKTFPPTEPKKDKKKKADETQALPQRQKKQQTVTLLPAADLDDFSKQL
QQSMSSADSTQA

Fig. 113 atgtctgataacggaccacagaatcagcgaaacgcaccacgcattacgtttggtggaccctcagattcaactggcagtaaccagaatggag
aacgcagtggagcgcgatctaaacaacgtcggcctcaaggtttacccaataatactgcgtcttggttcaccgctctcactcaacatggcaag
gaagaccttaaattccctcgaggacaaggcgttccaattaacaccaatagcagtcgagatgaccaaattggctactaccgaagagctacca
gacgaattcgtggtggtgacggtaagatgaaagatctcagtccaagatggtatttctactacctaggaactgggccagaagctggacttccc
tatggtgctaacaaagacggcatcatatgggttgcaactgagggagccttgaatacacctaaagatcacattggcacccgcaatcctgctaa
caatgctgcaatcgtgctacaacttcctcaaggaacaacattgcctaaaggcttctacgcagaagggagcagaggcggcagtcaagcctct
tctcgttcctcatcacgtagtcgcaacagttcaagaaattcaactccaggcagcagtaaacgaacttctcctgctagaatggctggcaatggc
ggtgatgctgctcttgctttgctgctgcttgacagattgaaccagcttgagagcaagatgtctggtaaaggccaacaacaacaaggccaaac
tgtcactaagaaatctgctgctgaggcttctaagaagcctcggcagaaacgtactgccactaaagcatacaatgtaacacaagctttcggca
gacgtggtccagaacaaacccaaggaaactttggagaccaggaactaatcagacaaggaactgattacaaacattggccgcaaattgcac
aatttgctcccagcgcttcagcgttcttcggaatgtcgcgcattggcatggaagtcacaccttcgggaacgtggttgacctacacaggtgcc
atcaaattggatgacaaagatccaaatttcaaagatcaagtcatattgctgaataagcatattgacgcatacaagacattcccaccaacagag
cctaagaaggacaagaagaagaaggctgatgaaactcaagccttaccgcagagacagaagaaacagcaaactgtgactcttcttcctgct
gcagatttggatgatttctccaaacaattgcaacaatccatgagcagtgctgactcaactcaggcctaa

Fig. 114

MSDNGPQNQRNAPRITFGGPSDSTGSNQNGERSGARSKQRRPQGLPNNTASWFTALTQ
HGKEDLKFPRGQGVPINTNSSRDDQIGYYRRATRRIRGGDGKMKDLSPRWYFYYLGTG
PEAGLPYGANKDGIIWVATEGALNTPKDHIGTRNPANNAAIVLQLPQGTTLPKGFYAEG
SRGGSQASSRSSSRSRNSSRNSTPGSSKRTSPARMAGNGGDAALALLLLDRLNQLESKM
SGKGQQQQGQTVTKKSAAEASKKPRQKRTATKAYNVTQAFGRRGPEQTQGNFGDQEL
IRQGTDYKHWPQIAQFAPSASAFFGMSRIGMEVTPSGTWLTYTGAIKLDDKDPNFKDQ
VILLNKHIDAYKTFPPTEPKKDKKKKADETQALPQRQKKQQTVTLLPAADLDDFSKQL
QQSMSSADSTQA

Fig. 115

```
atgtttgtctttcttgtcttattgccactagtctctagtcagtgtgttaatcttacaaccagaactcaattaccacctgcatacactaattctttcacac
gtggtgtttattaccctgacaaagtattcagatcctcagtattacattcaactcaggacttgttcttacctttcttctccaatgttacttggttccatgc
tatacatgtctctgggaccaatggtactaagaggtttgataaccctgtcctaccatttaatgatggtgtttatttcgcttccactgagaagtctaac
ataataagaggctggatatttggtactactttagattcgaagacccagtccctacttattgttaataacgctactaatgttgttattaaagtctgtga
atttcaattctgtaatgatccattcttggatgtttattaccacaagaacaacaagagttggatgaagagtgagttcagagtttattctagtgcgaat
aattgcactttcgaatatgtctctcagcctttccttatggaccttgaaggtaaacagggtaatttcaagaatcttagggaatttgtgtttaagaatat
tgatggttatttcaagatatattctaagcacacgcctattaatttagtgcgtgatctccctcagggtttctcggctttagaaccattggtagatttgc
caataggtattaacatcactaggtttcaaactttacttgctttacatagaagttatttgactcctggtgattcttcttcaggttggacagctggtgct
gcagcttattatgtgggttatcttcaacctaggactttcctattgaaatataatgagaatggaaccattacagatgctgtagactgtgcacttgac
cctctctcagaaacaaagtgtacgttgaaatccttcactgtagagaaaggaatctatcaaacttctaactttagagtccaaccaacagaatctat
tgttagatttcctaatattacaaacttgtgccctttcggtgaagtatttaacgccaccagatttgcatctgtttatgcttggaacaggaagagaatc
agcaactgtgttgctgattattctgtcctatataattccgcatcattctccacatttaagtgttatggagtgtctcctactaaattaaatgatctctgct
ttactaatgtctatgcagattcatttgtaattagaggtgatgaagtcagacaaatcgctccagggcaaactggaaagattgctgattataattata
aattaccagatgactttacaggctgcgttatagcttggaattctaacaatcttgattctaaggttggtggtaattataattaccggtatagattgttt
aggaagtctaatctcaaacctttcgagagagatatttcaactgaaatctatcaggccggtagcacaccttgtaatggtgttcaaggatttaattg
ttactttcctttacaatcatatggtttccaacccactaatggtgttggttaccaaccatacagagtagtagtactttcatttgaacttctacatgcac
cagcaactgtttgtggacctaagaagtctactaatttggttaagaacaaatgtgtcaatttcaacttcaatggtttaacaggcacaggtgttctta
ctgagtctaacaagaagtttctgcctttccaacaatttggcagagacattgctgacactactgatgctgtccgtgatccacagacacttgagatt
cttgacattacaccatgttcatttggtggtgtcagtgttataacaccaggaacaaatacttctaaccaggttgctgttctttatcagggtgttaact
gcacagaagtccctgttgctattcatgcagatcaacttactcctacttggcgtgtgtttattctacaggttctaatgtatttcaaacacgtgcaggctg
tttaataggagctgaacatgtcaacaactcatatgagtgtgacatacccattggtgcaggtatatgcgctagttatcagactcagactaattctc
gtcggcgggcacgtagtgtagctagtcaatccatcattgcctacactatgtcacttggtgcagagaattcagttgcttactctaataactctattg
ccatacccacaaactttactattagtgttaccacagaaattctaccagtgtctatgaccaagacatcagtagattgtacaatgtacatttgtggtg
attcaactgaatgcagcaatctattgttgcaatatggcagtttctgtacacaattaaaccgtgctttaactggaatagctgttgaacaagacaag
aacacccaagaagtatttgcacaagtcaaacaaatttacaagacaccaccaattaaagattcggtggatttaatttctcacaaatattaccaga
tccatctaaaccaagcaagaggtcatttattgaagatctactattcaacaaagtgacacttgcagatgctggcttcatcaaacaatatggtgatt
gccttggtgatattgctgctagagacctcatttgtgcacagaagtttaacggccttactgtattgccacctttgctcacagatgaaatgattgctc
aatacacttctgcactgttagcgggtacaatcacttctggttggacctttggtgcaggtgctgcattacaaataccatttgctatgcaaatggctt
ataggtttaatggtattggagttacacagaatgttctctatgagaaccagaaattgattgccaaccaatttaatagtgctattggcaagattcaag
actcactttcttccacagcaagtgcacttggtaaacttcaagatgtggtcaaccagaatgcacaagctttaaacacgcttgttaaacaacttag
ctccaactttggtgcaatttcaagtgtattaaatgatatcctttcacgtcttgacaaagttgaggctgaagtgcaaattgataggttgatcacagg
cagacttcaaagtttgcagacatatgtgactcaacaattaattagagctgcagaaatcagagcttctgctaatcttgctgctactaagatgtcag
agtgtgtacttggacaatctaagagagttgatttctgtggaaagggctatcatcttatgtccttccctcagtcagcacctcatggtgtagtcttctt
gcatgtgacttatgtccctgcacacgagaagaacttcacaactgctcctgccatttgtcatgatggtaaagcacactttcctcgtgaaggtgtct
ttgtttcaaatggcacagactggtttgtaacacaaaggaattctatgaaccacaaatcattactacagacaacacatttgtgtctggtaactgtg
atgttgtaataggaattgtcaacaacacagtttatgatcctttgcaacctgaattagactcattcaaggaggagttagataaatatttcaagaatc
atacatcaccagatgttgatttaggtgacatctctggcattaatgcttcagttgtaaacattcagaaagaaattgaccgcctcaatgaggttgcc
aagaatttaaatgaatctctcatcgatctccaagaacttggaaagtatgagcagtatatcaaatggccatggtacatttggctaggtttcatagc
tggcttgattgccatagtaatggtgacaattatgctttgctgtatgaccagttgctgtagttgtctcaagggctgttgttcttgtggatcctgctgc
aaatttgatgaagacgactctgagccagtgctcaaaggagtcaaattacattacacataa
```

Fig. 116

MFVFLVLLPLVSSQCVNLTTRTQLPPAYTNSFTRGVYYPDKVFRSSVLHSTQDLFLPFFS
NVTWFHAIHVSGTNGTKRFDNPVLPFNDGVYFASTEKSNIIRGWIFGTTLDSKTQSLLIV
NNATNVVIKVCEFQFCNDPFLDVYYHKNNKSWMKSEFRVYSSANNCTFEYVSQPFLM
DLEGKQGNFKNLREFVFKNIDGYFKIYSKHTPINLVRDLPQGFSALEPLVDLPIGINITRF
QTLLALHRSYLTPGDSSSGWTAGAAAYYVGYLQPRTFLLKYNENGTITDAVDCALDPL
SETKCTLKSFTVEKGIYQTSNFRVQPTESIVRFPNITNLCPFGEVFNATRFASVYAWNRK
RISNCVADYSVLYNSASFSTFKCYGVSPTKLNDLCFTNVYADSFVIRGDEVRQIAPGQTG
KIADYNYKLPDDFTGCVIAWNSNNLDSKVGGNYNYRYRLFRKSNLKPFERDISTEIYQA
GSTPCNGVQGFNCYFPLQSYGFQPTNGVGYQPYRVVVLSFELLHAPATVCGPKKSTNL
VKNKCVNFNFNGLTGTGVLTESNKKFLPFQQFGRDIADTTDAVRDPQTLEILDITPCSFG
GVSVITPGTNTSNQVAVLYQGVNCTEVPVAIHADQLTPTWRVYSTGSNVFQTRAGCLIG
AEHVNNSYECDIPIGAGICASYQTQTNSRRRARSVASQSIIAYTMSLGAENSVAYSNNSI
AIPTNFTISVTTEILPVSMTKTSVDCTMYICGDSTECSNLLLQYGSFCTQLNRALTGIAVE
QDKNTQEVFAQVKQIYKTPPIKDFGGFNFSQILPDPSKPSKRSFIEDLLFNKVTLADAGFI
KQYGDCLGDIAARDLICAQKFNGLTVLPPLLTDEMIAQYTSALLAGTITSGWTFGAGAA
LQIPFAMQMAYRFNGIGVTQNVLYENQKLIANQFNSAIGKIQDSLSSTASALGKLQDVV
NQNAQALNTLVKQLSSNFGAISSVLNDILSRLDKVEAEVQIDRLITGRLQSLQTYVTQQL
IRAAEIRASANLAATKMSECVLGQSKRVDFCGKGYHLMSFPQSAPHGVVFLHVTYVPA
HEKNFTTAPAICHDGKAHFPREGVFVSNGTDWFVTQRNFYEPQIITTDNTFVSGNCDVV
IGIVNNTVYDPLQPELDSFKEELDKYFKNHTSPDVDLGDISGINASVVNIQKEIDRLNEV
AKNLNESLIDLQELGKYEQYIKWPWYIWLGFIAGLIAIVMVTIMLCCMTSCCSCLKGCC
SCGSCCKFDEDDSEPVLKGVKLHYT

Fig. 117 atgtctgataacggaccacagaatcagcgaaacgcaccacgcattacgtttggtggaccctcagattcaactggcagtaaccagaatggag
aacgcagtggagcgcgatctaaacaacgtcggcctcaaggtttacccaataatactgcgtcttggttcaccgctctcactcaacatggcaag
gaagaccttaaattccctcgaggacaaggcgttccaattaacaccaatagcagtccagatgaccaaattggctactaccgaagagctacca
gacgaattcgtggtggtgacggtaagatgaaagatctcagtccaagatggtatttctactacctaggaactgggccagaagctggacttccc
tatggtgctaacaaagacggcatcatatgggttgcaactgagggagccttgaatacacctaaagatcacattggcacccgcaatcctgctaa
caatgctgcaatcgtgctacaacttcctcaaggaacaacattgcctaaaggcttctacgcagaagggagcagaggcggcagtcaagcctct
tctcgttcctcatcacgtagtcgcaacagttcaagaaattcaactccaggcagcagtatgggaacttctcctgctagaatggctggcaatggc
ggtgatgctgctcttgctttgctgctgcttgacagattgaaccagcttgagagcaagatgtctggtaaaggccaacaacaacaaggccaaac
tgtcactaagaaatctgctgctgaggcttctaagaagcctcggcagaaacgtactgccactaaagcatacaatgtaacacaagctttcggca
gacgtggtccagaacaaacccaaggaaactttggagaccaggaactaatcagacaaggaactgattacaaacattggccgcaaattgcac
aatttgctcccagcgcttcagcgttcttcggaatgtcgcgcattggcatggaagtcacaccttcgggaacgtggttgacctacacaggtgcc
atcaaattggatgacaaagatccaaatttcaaagatcaagtcatattgctgaataagcatattgacgcatacaagacattcccaccaacagag
cctaagaaggacaagaagaagaaggcttatgaaactcaagccttaccgcagagacagaagaaacagcaaactgtgactcttcttcctgct
gcagatttggatgatttctccaaacaattgcaacaatccatgagcagtgctgactcaactcaggcctaa

Fig. 118

MSDNGPQNQRNAPRITFGGPSDSTGSNQNGERSGARSKQRRPQGLPNNTASWFTALTQ
HGKEDLKFPRGQGVPINTNSSPDDQIGYYRRATRRIRGGDGKMKDLSPRWYFYYLGTG
PEAGLPYGANKDGIIWVATEGALNTPKDHIGTRNPANNAAIVLQLPQGTTLPKGFYAEG
SRGGSQASSRSSSRSRNSSRNSTPGSSMGTSPARMAGNGGDAALALLLLDRLNQLESKM
SGKGQQQQGQTVTKKSAAEASKKPRQKRTATKAYNVTQAFGRRGPEQTQGNFGDQEL
IRQGTDYKHWPQIAQFAPSASAFFGMSRIGMEVTPSGTWLTYTGAIKLDDKDPNFKDQ
VILLNKHIDAYKTFPPTEPKKDKKKKAYETQALPQRQKKQQTVTLLPAADLDDFSKQL
QQSMSSADSTQA

SYNTHETIC MODIFIED VACCINIA ANKARA (SMVA) BASED CORONAVIRUS VACCINES

PRIORITY CLAIM

This application is a continuation of U.S. patent application Ser. No. 17/999,170, filed Nov. 17, 2022, which is a national stage application of International Patent Application No. PCT/US21/32821, filed May 17, 2021, which claims priority to U.S. Provisional Patent Application No. 63/026,127, filed May 17, 2020, U.S. Provisional Patent Application No. 63/044,033, filed Jun. 25, 2020, U.S. Provisional Patent Application No. 63/113,810, filed Nov. 13, 2020, and U.S. Provisional Patent Application No. 63/161,371, filed Mar. 15, 2021, the contents of which are hereby incorporated by reference in their entireties.

SEQUENCE LISTING

This application contains a ST.26 compliant Sequence Listing, which was submitted in XML format via Patent Center, and is hereby incorporated by reference in its entirety. The XML copy, created on Oct. 22, 2025, is named Substitute_Sequence_Listing_0544358206US06.xml and is 921,000 bytes in size.

BACKGROUND

Modified Vaccinia Ankara (MVA) is a highly attenuated orthopoxvirus that was derived from its parental strain Chorioallantois Vaccinia Ankara (CVA) by 570 passages on chicken embryo fibroblasts (CEF). As a result of the attenuation process MVA has acquired six major genome deletions (Del1-6) as well as multiple shorter deletions, insertions, and point mutations, leading to gene fragmentation, truncation, short internal deletions, and amino acid substitutions. MVA has severely restricted host cell tropism, allowing productive assembly only in avian cells, e.g., CEF and baby hamster kidney (BHK) cells, whereas in human and most other mammalian cells, MVA assembly is abortive due to a late block in virus assembly. Although non-pathogenic and highly attenuated, MVA maintains excellent immunogenicity as demonstrated in various animal models and humans. In the late phase of the smallpox eradication campaign, MVA was used as a priming vector for the replication competent vaccinia-based vaccine in over 120,000 individuals in Germany and no adverse events were reported. In the past decades, MVA has been developed as a stand-alone smallpox vaccine and is currently pursued by the United States (US) government as a safer alternative to substitute the existing vaccinia-based vaccine stocks as a preventative countermeasure in case of a smallpox outbreak. The FDA approved MVA, under the trade name Jynneos (Bavarian Nordic) on Sep. 24, 2019 to prevent both smallpox and monkey pox. Previously, a similar MVA vaccine using the trade name Imvamune was approved in Europe as a smallpox vaccine. Almost all organizations that we are aware of which currently use MVA vectors or derivatives thereof are licensed or owned by academic, commercial, or governmental entities, which greatly restricts their use to commercially develop MVA-based vaccine vectors.

Coronaviruses are a large family of enveloped, positive-sense single stranded RNA viruses that can infect people and cause serious infections and even pandemics. Such highly infectious coronaviruses include, for example, MERS-CoV, SARS-CoV, and SARS-CoV-2. Since the recent outbreak of the novel severe acute respiratory syndrome coronavirus-2 (SARS-CoV-2, also known as Covid-19 or nCOV-2019) (PMC7095418, PMC7092803), the virus has spread to more than 200 countries, leading to over 3 million deaths worldwide. Although several effective SARS-CoV-2 vaccines have been developed with unprecedented pace and approved for emergency use, additional vaccines can contribute to establish long-term and cross-reactive immunity against SARS-CoV-2 and many of its emerging variants. Therefore, this disclosure provides vaccines using a synthetic MVA platform to satisfy an urgent need in the field.

SUMMARY

In one aspect, disclosed herein is a vaccine composition for preventing or treating a virus infection such as coronavirus infection in a subject comprising: (i) a single DNA fragment comprising the entire genome of MVA, or two or more DNA fragments each comprising a partial sequence of the genome of the MVA such that the two or more DNA fragments, when expressed in the host cell upon co-transfection, are assembled sequentially and comprise the full-length sequence of the MVA genome, and (ii) one or more DNA sequences encoding one or more human coronavirus antigens, subunits, or fragments thereof inserted in one or more insertion sites of the MVA, wherein the antigens, subunits, or fragments thereof are expressed in the host cell upon transfection of the one or more DNA fragments. In certain embodiments, the DNA sequences of the antigens, subunits, or fragments thereof are codon optimized for expression in the host cell or vaccinia virus. In certain embodiments, the one or more human coronavirus antigens include the Spike(S) protein, the Nucleocapsid (N) protein, Membrane (M) protein, and Envelope (E) protein, papain-like protease, ORF1A, 3CL protease, ORF1B, endoribonuclease, matrix, helicase, or immunogenic fragments thereof. Other coronavirus antigens of the structural or non-structural (1a, 1b) proteins can be included as well. In certain embodiments, the one or more human coronavirus antigens include SARS-CoV-2 S protein, N protein, or both. In certain embodiments, the one or more antigens include a subunit of the S protein such as S1 and S2 domains, or the receptor-binding domain (RBD) of the S protein. In certain embodiments, the one or more antigens include a prefusion form of the S protein or N protein or a mutated S protein or N protein. For example, the prefusion form of the SARS-CoV-2 S protein can be stabilized or the SARS-CoV-2 S protein can be further stabilized by including a mutated Furin cleavage site such that amino acid residues 682-685 RRAR are mutated to GSAS. In another example, lysine 986 and valine 987 of the SARS-CoV-2 S protein are substituted with prolines (2P). Additional proline substitutions include F817P, A892P, A899P, and A942P. Similar Furin cleavage site mutations and proline substitutions can be included at the respective amino acid positions in other coronavirus S proteins to express uncleaved and/or 2P prefusion stabilized protein forms. In certain embodiments, the S protein comprises one or more of the mutations selected from the group consisting of S13I, L18F, T19R, T20N, R21T, P26S, a deletion of histidine, and valine at positions 69 and 70, K77T, D80A, T95I, D138Y, G142D, a deletion of tyrosine at position 144, W152C, E154K, a deletion of glutamic acid and phenylalanine at amino acid position 156 and 157 (Del156-157), R158G, R190S, D215G, Q218H, a deletion of leucine, alanine, and leucine at position 242-244, R246I, K417N, K417T, N439K, L452R, Y453F, S477N, T478K, E484K, E484Q, S494P, N501Y, S520S, A570D, D614G, H655Y, P681H, P681R, RRAR682-685GSAS, A701V, T716I, D950N, S982A, K986P, V987P, T1027I, Q1071H, H1101D, D1118H, and V1176F. In certain embodiments, the N protein comprises one or more of the mutations selected from the group consisting of D3L, P80R, S235F, R203K, R203M, G204R, T205I, and D377Y. In certain embodiments, the S protein and the N protein are fully mature or fully glycosylated. In certain embodiments, the S and N proteins are inserted in one or more MVA insertion sites. In certain embodiments, the one or more antigens comprise at least two RBDs from different variants of SARS-CoV-2, which can be linked by one or more GS linkers, and each of which can comprise a signal peptide at the N-terminus, or a transmembrane domain or a cytoplastic domain at the C-terminus. In certain embodiments, the one or more DNA fragments further comprise a virus promoter upstream of the DNA sequences encoding the human coronavirus antigens, subunits, or fragments thereof, a transcription termination signal downstream of the DNA sequences encoding the human coronavirus antigens, subunits, or fragments thereof, or both. In certain embodiments, the promoter sequences include mH5 and p7.5 promoters, or any other suitable native or synthetic vaccinia or poxvirus promoters. In certain embodiments, the DNA sequences encoding the antigens, subunits, or fragments thereof are inserted in one or more MVA insertion sites such as intergenic regions, non-essential genes and regions, and deletion sites. In certain embodiments, the vaccine composition further comprises a pharmaceutically acceptable carrier, adjuvant, additive or combination thereof. In certain embodiments, the subject is infected with or at a risk of being infected with a coronavirus such as a betacoronavirus, including MERS-CoV, SARS-COV and SARS-CoV2, 229E, NL63, OC43, HKU1, and other alpha, beta, gamma, and delta coronaviruses. In certain embodiments, the subject is infected with or at a risk of being infected with SARS-CoV-2.

In another aspect, disclosed herein is a method of preventing or treating a viral infection in a subject comprising administering a prophylactically or therapeutically effective amount of a vaccine composition to the subject, wherein the vaccine comprises: (i) a single DNA fragment comprising the entire genome of an MVA, or two or more DNA fragments each comprising a partial sequence of the genome of the MVA such that the two or more DNA fragments, when expressed in the host cell upon co-transfection, are assembled sequentially and comprise the full-length sequence of the MVA genome, and (ii) one or more DNA sequences encoding one or more human coronavirus antigens, subunits, or fragments thereof inserted in one or more insertion sites of the MVA, wherein the antigens, subunits, or fragments thereof are expressed in the host cell upon transfection of the one or more DNA fragments. In certain embodiments, the DNA sequences of the antigens, subunits, or fragments thereof are codon optimized for expression in the host cell or vaccinia virus. In certain embodiments, the one or more human coronavirus antigens include the Spike (S) protein, the Nucleocapsid (N) protein, Membrane (M) protein, and Envelope (E) protein, papain-like protease, ORF1A, 3CL protease, ORF1B, endoribonuclease, matrix, helicase, or immunogenic fragments thereof. Other coronavirus antigens of the structural or non-structural (1a, 1b) proteins can be included as well. In certain embodiments, the one or more human coronavirus antigens include SARS-CoV-2 S protein, N protein, or both. In certain embodiments, the one or more antigens include a subunit of the S protein such as S1 and S2 domains, or the receptor-binding domain (RBD) of the S protein. In certain embodiments, the one or more antigens include a prefusion form of the S protein and a mutated S protein. For example, the prefusion form of the SARS-CoV-2 S protein can be stabilized or the SARS-CoV-2 S protein can be further stabilized by including a mutated Furin cleavage site such that amino acid residues 682-685 RRAR are mutated to GSAS (RRAR682-685GSAS). In another example, lysine 986 and valine 987 of the SARS-CoV-2 S protein are substituted with prolines (2P) (K986P and V987P). Additional proline substitutions include F817P, A892P, A899P, and A942P. Similar Furin cleavage site mutations and proline substitutions can be included at the respective amino acid positions in other coronavirus S proteins to express uncleaved and/or 2P prefusion stabilized protein forms. In certain embodiments, the S protein comprises one or more of the mutations selected from the group consisting of S13I, L18F, T19R, T20N, R21T, P26S, a deletion of histidine, and valine at positions 69 and 70, K77T, D80A, T95I, D138Y, G142D, a deletion of tyrosine at position 144, W152C, E154K, a deletion of glutamic acid and phenylalanine at amino acid position 156 and 157 (Del156-157), R158G, R190S, D215G, Q218H, a deletion of leucine, alanine, and leucine at position 242-244, R246I, K417N, K417T, N439K, L452R, Y453F, S477N, T478K, E484K, E484Q, S494P, N501Y, S520S, A570D, D614G, H655Y, P681H, P681R, RRAR682-685GSAS, A701V, T716I, D950N, S982A, K986P, V987P, T1027I, Q1071H, H1101D, D1118H, and V1176F. In certain embodiments, the N protein comprises one or more of the mutations selected from the group consisting of D3L, P80R, S235F, R203K, R203M, G204R, T205I, and D377Y. In certain embodiments, the S protein and the N protein are fully mature or fully glycosylated. In certain embodiments, the one or more antigens comprise at least two RBDs from different variants of SARS-CoV-2, which can be linked by one or more GS linkers, and each of which can comprise a signal peptide at the N-terminus, or a transmembrane domain or a cytoplastic domain at the C-terminus. In certain embodiments, the S and N proteins are inserted in one or more MVA insertion sites. In certain embodiments, the one or more DNA fragments further comprise a virus promoter upstream of the DNA sequences encoding the human coronavirus antigens, subunits, or fragments thereof, a transcription termination signal downstream of the DNA sequences encoding the human coronavirus antigens, subunits, or fragments thereof, or both. In certain embodiments, the promoter sequences include mH5 and p7.5 promoters, or any other suitable native or synthetic vaccinia or poxvirus promoters. In certain embodiments, the DNA sequences encoding the antigens, subunits, or fragments thereof are inserted in one or more MVA insertion sites such as intergenic regions, non-essential genes and regions, and deletion sites. In certain embodiments, the vaccine composition further comprises a pharmaceutically acceptable carrier, adjuvant, additive or combination thereof. In certain embodiments, the subject is infected with or at a risk of being infected with a coronavirus such as a betacoronavirus, including MERS-CoV, SARS-COV and SARS-CoV2, 229E, NL63, OC43, HKU1, and other alpha, beta, gamma, and delta coronaviruses. In certain embodiments, the subject is infected with or at a risk of being infected with SARS-CoV-2.

In another aspect, disclosed herein is a method of eliciting an immune response in a subject comprising administering a prophylactically or therapeutically effective amount of a vaccine composition to the subject, wherein the vaccine comprises: (i) a single DNA fragment comprising the entire genome of an MVA, or two or more DNA fragments each comprising a partial sequence of the genome of the MVA such that the two or more DNA fragments, when expressed in the host cell upon co-transfection, are assembled sequentially and comprise the full-length sequence of the MVA genome, and (ii) one or more DNA sequences encoding one or more human coronavirus antigens, subunits, or fragments thereof inserted in one or more insertion sites of the MVA, wherein the antigens, subunits, or fragments thereof are expressed in the host cell upon transfection of the one or more DNA fragments. In certain embodiments, the DNA sequences of the antigens, subunits, or fragments thereof are codon optimized for expression in the host cell. In certain embodiments, the one or more human coronavirus antigens include the Spike(S) protein, the Nucleocapsid (N) protein, Membrane (M) protein, and Envelope (E) protein, papain-like protease, ORF1A, 3CL protease, ORF1B, endoribonuclease, matrix, helicase, or immunogenic fragments thereof. Other coronavirus antigens of the structural or non-structural (1a, 1b) proteins can be included as well. In certain embodiments, the one or more human coronavirus antigens include SARS-CoV-2 S protein, N protein, or both. In certain embodiments, the one or more antigens include a subunit of the S protein such as S1 and S2 domains, or the receptor-binding domain (RBD) of the S protein. In certain embodiments, the one or more antigens include a prefusion form of the S protein and a mutated S protein. For example, the prefusion form of the SARS-CoV-2 S protein can be stabilized or the SARS-CoV-2 S protein can be further stabilized by including a mutated Furin cleavage site such that amino acid residues 682-685 RRAR are mutated to GSAS. In another example, lysine 986 and valine 987 of the SARS-CoV-2 S protein are substituted with prolines (2P). Additional proline substitutions include F817P, A892P, A899P, and A942P. Similar Furin cleavage site mutations and proline substitutions can be included at the respective amino acid positions in other coronavirus S proteins to express uncleaved and/or 2P prefusion stabilized protein forms. In certain embodiments, the S protein comprises one or more of the mutations selected from the group consisting of S13I, L18F, T19R, T20N, R21T, P26S, a deletion of histidine, and valine at positions 69 and 70, K77T, D80A, T95I, D138Y, G142D, a deletion of tyrosine at position 144, W152C, E154K, a deletion of glutamic acid and phenylalanine at amino acid position 156 and 157 (Del156-157), R158G, R190S, D215G, Q218H, a deletion of leucine, alanine, and leucine at position 242-244, R246I, K417N, K417T, N439K, L452R, Y453F, S477N, T478K, E484K, E484Q, S494P, N501Y, S520S, A570D, D614G, H655Y, P681H, P681R, RRAR682-685GSAS, A701V, T716I, D950N, S982A, K986P, V987P, T1027I, Q1071H, H1101D, D1118H, and V1176F. In certain embodiments, the N protein comprises one or more of the mutations selected from the group consisting of D3L, P80R, S235F, R203K, R203M, G204R, T205I, and D377Y. In certain embodiments, the S protein and the N protein are fully mature or fully glycosylated. In certain embodiments, the one or more antigens comprise at least two RBDs from different variants of SARS-CoV-2, which can be linked by one or more GS linkers, and each of which can comprise a signal peptide at the N-terminus, or a transmembrane domain or a cytoplastic domain at the C-terminus. In certain embodiments, the S and N proteins are inserted in one or more MVA insertion sites. In certain embodiments, the one or more DNA fragments further comprise a virus promoter upstream of the DNA sequences encoding the human coronavirus antigens, subunits, or fragments thereof, a transcription termination signal downstream of the DNA sequences encoding the human coronavirus antigens, subunits, or fragments thereof, or both. In certain embodiments, the promoter sequences include mH5 and p7.5 promoters, or any other suitable native or synthetic vaccinia or poxvirus promoters. In certain embodiments, the DNA sequences encoding the antigens, subunits, or fragments thereof are inserted in one or more MVA insertion sites such as intergenic regions, non-essential genes and regions, and deletion sites. In certain embodiments, the vaccine composition further comprises a pharmaceutically acceptable carrier, adjuvant, additive or combination thereof. In certain embodiments, the subject is infected with or at a risk of being infected with a coronavirus such as a betacoronavirus, including MERS-CoV, SARS-COV and SARS-CoV2, 229E, NL63, OC43, HKU1, and other alpha, beta, gamma, and delta coronaviruses. In certain embodiments, the subject is infected with or at a risk of being infected with SARS-CoV-2.

In yet another aspect, this disclosure relates to a method of producing an MVA vector or a recombinant MVA vector. The method entails the steps of transfecting one or more DNA fragments into a host cell, wherein the one or more DNA fragments comprise the entire genomic DNA sequence of an MVA species, such that the MVA virus is reconstituted in the host cell. In certain embodiments, two or more DNA fragments are co-transfected into the host cell, each DNA fragment comprises a partial sequence of the MVA genome such that the two or more DNA fragments are assembled sequentially by homologous recombination and comprise the full-length sequence of the MVA genome when reconstituted in the host cell. In certain embodiments, the method further entails infecting the host cell with a helper virus before, during, or after the transfection of the one or more DNA fragments to initiate the transcription of the one or more DNA fragments. In certain embodiments, the helper virus is Fowl pox virus (FPV) or any other helper virus that stimulates MVA, vaccinia, or poxvirus transcription. In certain embodiments, the one or more DNA fragments are circularized before transfection or transfected in circular forms into the host cell. In certain embodiments, the one or more DNA fragments are cloned into a plasmid or a bacterial artificial chromosome (BAC) vector. In certain embodiments, the one or more DNA fragments are naturally derived, chemically synthesized, or a combination of naturally derived and chemically synthesized DNA fragments. In certain embodiments, the MVA genomic sequence comprises the sequence of Accession No. #U94848. In certain embodiments, two adjacent DNA fragments have an overlapping sequence to facilitate homologous recombination. In certain embodiments, the overlapping sequence is between about 100 bp and about 5000 bp in length. In certain embodiments, the one or more DNA fragments further comprise an inverted terminal repeat (ITR) region. In certain embodiments, the one or more DNA fragments further comprise an MVA terminal hairpin loop (HL) sequence, an MVA genome resolution (CR) sequence, or both, wherein the HL or the CR sequence is added to one or both ends of the DNA fragment as single stranded or double stranded DNA sequences in sense or antisense orientation. In certain embodiments, the one or more DNA fragments further comprise one or more HL sequences and one or more CR sequences. In certain embodiments, each HL sequence is flanked by two CR sequences at both ends of the HL sequence. In certain embodiments, the one or more DNA fragments further comprise one or more DNA sequences encoding one or more antigens, subunits, or fragments thereof. In certain embodiments, the DNA sequences of the antigens, subunits, or fragments thereof are codon optimized for expression in the host cell, e.g., in human cells or vaccinia virus, and/or codon optimized for stability in vaccinia by silent-codon alternation to avoid 4 or more of the same nucleotides consecutively. In certain embodiments, the one or more antigens include human coronavirus antigens such as the Spike(S) protein, the Nucleocapsid (N) protein, Membrane (M) protein, and Envelope (E) protein, papain-like protease, ORF1A, 3CL protease, ORF1B, endoribonuclease, matrix, helicase, or immunogenic fragments thereof. Other coronavirus antigens of the structural or non-structural (1a, 1b) proteins can be included as well. In certain embodiments, the one or more antigens include a subunit of the S protein such as S1 and S2 domains, or the receptor-binding domain (RBD) of the S protein. In certain embodiments, the one or more antigens include a prefusion form of the S protein and a mutated S protein. For example, the prefusion form of the SARS-CoV-2 S protein can be stabilized or the SARS-CoV-2 S protein can be further stabilized by including a mutated Furin cleavage site such that amino acid residues 682-685 RRAR are mutated to GSAS. In another example, lysine 986 and valine 987 of the SARS-CoV-2 S protein are substituted with prolines (2P). Additional proline substitutions include F817P, A892P, A899P, and A942P. Similar Furin cleavage site mutations and proline substitutions can be included at the respective amino acid positions in other coronavirus S proteins to express uncleaved and/or 2P prefusion stabilized protein forms. In certain embodiments, the S protein comprises one or more of the mutations selected from the group consisting of S13L, L18F, T19R, T20N, R21T, P26S, a deletion of histidine, and valine at positions 69 and 70, K77T, D80A, T95I, D138Y, G142D, a deletion of tyrosine at position 144, W152C, E154K, a deletion of glutamic acid and phenylalanine at amino acid position 156 and 157 (Del156-157), R158G, R190S, D215G, Q218H, a deletion of leucine, alanine, and leucine at position 242-244, R246I, K417N, K417T, N439K, L452R, Y453F, S477N, E484K, E484Q, S494P, N501Y, S520S, A570D, D614G, H655Y, P681H, P681R, RRAR682-685GSAS, A701V, T716I, D950N, S982A, K986P, V987P, T1027I, Q1071H, H1101D, D1118H, and V1176F. In certain embodiments, the N protein comprises one or more of the mutations selected from the group consisting of D3L, P80R, S235F, R203K, R203M, G204R, T205I, and D377Y. In certain embodiments, the S protein and the N protein are fully mature or fully glycosylated. In certain embodiments, the one or more DNA fragments further comprise a virus promoter upstream of the DNA sequences of the antigens, subunits, or fragments thereof, a transcription termination signal downstream the DNA sequences of the antigens, subunits, or fragments thereof, or both. In certain embodiments, the promoter sequences include mH5 and p7.5 promoters, or any other suitable native or synthetic vaccinia or poxvirus promoters. In certain embodiments, the DNA sequences encoding the antigens, subunits, or fragments thereof are inserted in one or more MVA insertion sites such as intergenic regions, non-essential genes and regions, and deletion sites. In another embodiment, the one or more expressed SARS-CoV-2 antigens are further modified to contain one or more mutations of emerging variants of concern (VOC).

BRIEF DESCRIPTION OF THE DRAWINGS

FIGS. 1A-1F show sMVA construction and characterization. FIG. 1A: Schematic of MVA genome. The MVA genome is about 178 kbp in length and contains about 9.6 kbp inverted terminal repeat (ITR) sequences. FIG. 1B:

sMVA fragments. The three sub-genomic sMVA fragments (F1-F3) comprise about 60 kbp of the left, central, and right part of the MVA genome as indicated. sMVA F1/F2 and F2/F3 share about 3 kbp overlapping homologous sequences for recombination (red dotted crossed lines). Approximate genome positions of commonly used MVA insertion (Del2, IGR69/70, Del3) are indicated. FIG. 1C: Terminal CR/HL/CR sequences. Each of the sMVA fragments contains at both ends a sequence composition comprising a duplex copy of the MVA terminal hairpin loop (HL) flanked by concatemeric resolution (CR) sequences. BAC=bacterial artificial chromosome vector. FIG. 1D: sMVA reconstitution. The sMVA fragments are isolated from the *E. coli* and co-transfected into BHK-21 cells, which are subsequently infected with FPV as a helper virus to initiate sMVA virus reconstitution. FIG. 1E: PCR analysis. CEF infected with sMVA, derived with FPV HP1.441 (sMVA hp) or TROVAC from two independent virus reconstitutions (sMVA tv1 and sMVA tv2), were investigated by PCR for several MVA genome positions (ITR sequences, transition left or right ITR into internal unique region (left ITR/UR; UR/right ITR), Del2, IGR69/70 and Del3 insertion sites, and F1/F2 and F2/F3 recombination sites) and absence of BAC vector sequences. PCR reactions with wtMVA-infected and uninfected cells, without sample (mock), or with MVA BAC were performed as controls. FIG. 1F: Restriction fragment length analysis. Viral DNA isolated from purified sMVA (sMVA tv1 and sMVA tv2) or wtMVA virus was compared by KpnI and XhoI restriction enzyme digestion.

FIGS. 2A-2D show sMVA replication properties. The replication properties of sMVA derived with FPV HP1.441 (sMVA hp) or TROVAC from two independent sMVA virus reconstitution (sMVA tv1 and sMVA tv2) were compared with wtMVA. FIG. 2A: Viral foci. CEF infected at low multiplicity of infection (MOI) with the reconstituted sMVA virus or wtMVA were immunostained using anti-Vaccinia polyclonal antibody (αVAC). FIG. 2B: Replication kinetics. BHK-21 or CEF cells were infected at 0.02 MOI with sMVA or wtMVA and viral titers of the inoculum and infected cells at 24 and 48 hours post infection were determined on CEF. Mixed-effects model with the Geisser-Greenhouse correction was applied; at 24 and 48 hours post-infection differences between groups were not significant. FIG. 2C: Viral foci size analysis. BHK-21 or CEF cell monolayers were infected at 0.002 MOI with sMVA or wtMVA and areas of viral foci were determined at 24 hours post infection following immunostaining with αVAC antibody. FIG. 2D: Host cell range analysis. Various human cell lines (HEK293, A549, 143b, and HeLa), CEF or BHK-21 cells were infected at 0.01 MOI with sMVA or wtMVA and virus titers were determined at 48 hours post infection on CEF. Dotted lines indicate the calculated virus titer of the inoculum based on 0.01 MOI. Differences between groups in FIGS. 2C-2D were calculated using one-way ANOVA followed by Tukey's (2C) or Dunnett's (2D) multiple comparison tests. ns=not significant.

FIGS. 3A-3D demonstrate sMVA in vivo immunogenicity. sMVA derived either with FPV HP1.441 (sMVA hp) or TROVAC from two independent virus reconstitution (sMVA tv1 and sMVA tv2) was compared by in vitro analysis with wtMVA. C57BL/6 mice were immunized twice at three-week interval with low ($1 \times 10^7$ PFU) or high ($5 \times 10^7$ PFU) dose of sMVA or wtMVA. Mock-immunized mice were used as controls. FIG. 3A: Binding antibodies. MVA-specific binding antibodies (IgG titer) stimulated by sMVA or wtMVA were measured after the first and second immunization by ELISA. FIG. 3B: NAb responses. MVA-specific NAb titers induced by sMVA or wtMVA were measured after the booster immunization against recombinant wtMVA expressing a GFP marker. FIGS. 3C-3D: T cell responses. MVA-specific IFNγ, TNFα, IL-4, and IL-10-secreting CD8+ (3C) and CD4+ (3D) T cell responses induced by sMVA or wtMVA after two immunizations were measured by flow cytometry following ex vivo antigen stimulation using B8R immunodominant peptides. Differences between groups were evaluated using one-way ANOVA with Tukey's multiple comparison test. ns=not significant.

FIGS. 4A-4D demonstrate sMVA immunogenicity in vivo. sMVA derived either with FPV strain HP1.441 (sMVA hp) or with FPV strain TROVAC from two independent virus reconstitution (sMVA tv1 and sMVA tv2) was compared by in vitro analysis with wtMVA. C57BL/6 mice (N=4) were immunized twice in a three-week interval with low (1×10⁷ PFU) or high (5×10⁷ PFU) dose of sMVA or wtMVA. Mock-immunized mice were used as controls. FIG. 4A: Binding antibodies. Shown is the absorbance at 450 nm at different serum dilutions of MVA-specific binding antibodies (IgG titer) measured by ELISA after the first and second immunization in mice receiving sMVA or wtMVA. FIG. 4B: NAb responses. MVA-specific NAb titers induced by sMVA or wtMVA were measured after the booster immunization against wtMVA expressing a GFP marker. Shown is the measured GFP area of infected cells in square pixels (pix²×10³) at different serum dilutions. FIGS. 4C-4D: T cell responses. MVA-specific CD8+ (4C) and CD4+ (4D) T cells expressing IFNγ, TNFα, IL-4, and IL-10 were measured after two immunizations with sMVA or wtMVA by flow cytometry following ex vivo antigen stimulation using Vaccinia A19L immunodominant peptides. Differences between groups were evaluated using one-way ANOVA with Tukey's multiple comparison test. ns=not significant.

FIG. 5A: Schematic representation of vector construction. S and N antigen sequences (spheres and triangles) were inserted into sMVA fragments F2 and F3 by bacterial recombination methods in *E. coli*. The modified sMVA fragments of F1 and F2 with inserted antigen sequences and the unmodified sMVA fragment F1 were isolated from *E. coli* and co-transfected into FPV-infected BHK-21 cells to initiate virus reconstitution. FIG. 5B: Schematics of single (sMVA-S, sMVA-N) and double (sMVA-N/S, sMVA-S/N) recombinant sMVA-CoV2 vectors with S and N antigen sequences inserted into commonly used MVA insertion sites (Del2, IGR69/70, Del3). All antigens were expressed via the Vaccinia mH5 promoter. ITR represents inverted terminal repeat. FIG. 5C: PCR analysis. CEFs infected with the sMVA-CoV2 vectors were evaluated by PCR with primers specific for the Del2 and Del3 insertion sites harboring the N and S antigen sequences or primers specific for the F1/F2 and F2/F3 recombination sites. FIG. 5D: Western Blot. BHK-21 cells infected with the single and double recombinant sMVA-CoV2 vectors derived with FPV HP1.441 (sMVA-S/N hp, sMVA-N/S hp) or TROVAC (sMVA-S/N tv, sMVA-N/S tv, sMVA-S tv, sMVA-N tv) were evaluated for antigen expression by Western Blot using anti-S1 and N antibodies (aS1 and aN Abs). Vaccinia B5R protein was verified as infection control. Higher and lower molecular weight bands may represent mature and immature protein species. FIG. 5E: Flow cytometry staining. Hela cells infected with the vaccine vectors were evaluated by cell surface and intracellular flow staining using anti-S1, S2, and N antibodies (αS1, αS2, and αN Abs). Live cells were used to evaluate cell surface antigen expression. Fixed and permeabilized cells were used to evaluate intracellular antigen expression. Anti-Vaccinia virus antibody (αVAC) was used as staining control to verify MVA protein expression. Cells infected with sMVA or wtMVA or uninfected cells were used as controls for experiments in C, D and E as indicated. The experiments in C, D, and E were performed twice with similar results.

FIGS. 6A-6C: Immunofluorescence imaging. S and N antigen expression by the single (sMVA-S and sMVA-N) and double (sMVA-S/N and sMVA-N/S) recombinant vaccine sMVA-CoV2 vectors, all derived with FPV HP1.441, was evaluated in BHK-21 (6A and 6B) or HeLa (6C) cells by immunofluorescent confocal imaging using N and S-specific antibodies. Fluorescently-conjugated wheat germ agglutinin (WGA) was used in 6B and 6C to stain the cell membrane. Magnified insets are found below images. Scale bars in 6A, 50 μm. Scale bars in 6B and 6C, 10 μm. All images represent two independent experiments with similar results. FIG. 6D: Flow cytometry dual staining. Hela cells infected with the single (sMVA-N, sMVA-S) or double (sMVA-N/S, sMVA-S/N) recombinant sMVA-CoV2 vectors derived either with FPV TROVAC (tv) or HP1.441 (hp) were analyzed by intracellular flow cytometry analysis using dual staining with mouse anti-S2 and rabbit anti-N monoclonal antibodies followed by anti-mouse Alexa Fluor 488 and anti-rabbit Alexa Fluor 647. Percentage of cells dually stained by the S and N-specific antibodies is indicated in the upper-right quadrant (Q2).

FIGS. 7A-7B: Binding antibodies. S, RBD, and N-specific binding antibodies induced by the vaccine vectors were evaluated after the first (7A) and second (7B) immunization by ELISA. Dashed lines in 7A and 7B indicate median binding antibody endpoint titers measured in convalescent human sera (FIG. 9). One-way ANOVA with Tukey's multiple comparison test was used to evaluate differences between binding antibody end-point titers. FIG. 7C: IgG2a/IgG1 isotype ratio. S-, RBD-, and N-specific binding antibodies of the IgG2a and IgG1 isotype were measured after the second immunization using 1:10, 000 serum dilution, and absorbance reading was used to calculate IgG2a/IgG1 antibody ratio. One-way ANOVA with Dunnett's multiple comparison test was used to compare each group mean IgG2a/IgG1 ratio to a ratio of 1 (balanced Th1/Th2 response). FIGS. 7D-7G: NAb responses. SARS-CoV-2-specific NAb (NT90 titer) induced by the vaccine vectors were measured after the first (7D, 7F) and second (7E, 7G) immunization against SARS-CoV-2 pseudovirus (pv) (7D-7E) or infectious authentic SARS-CoV-2 virus (7F-7G) in pooled sera of immunized mice. Shown is the average NT90 measured in duplicate (7D-7E) or triplicate (7F-7G) infection. N/A=failed quality control of the samples. Dotted lines indicate lowest antibody dilution included in the analysis. FIG. 7H: SARS-CoV-2/SARS-CoV-2pv correlation analysis. Correlation analysis of NT90 measured in mouse sera after one and two immunizations using infectious SARS-CoV-2 virus and SARS-CoV-2pv. Pearson correlation coefficient (r) was calculated in H. *p<0.05. ns=not significant.

Figures 7A, 7B, 7C:
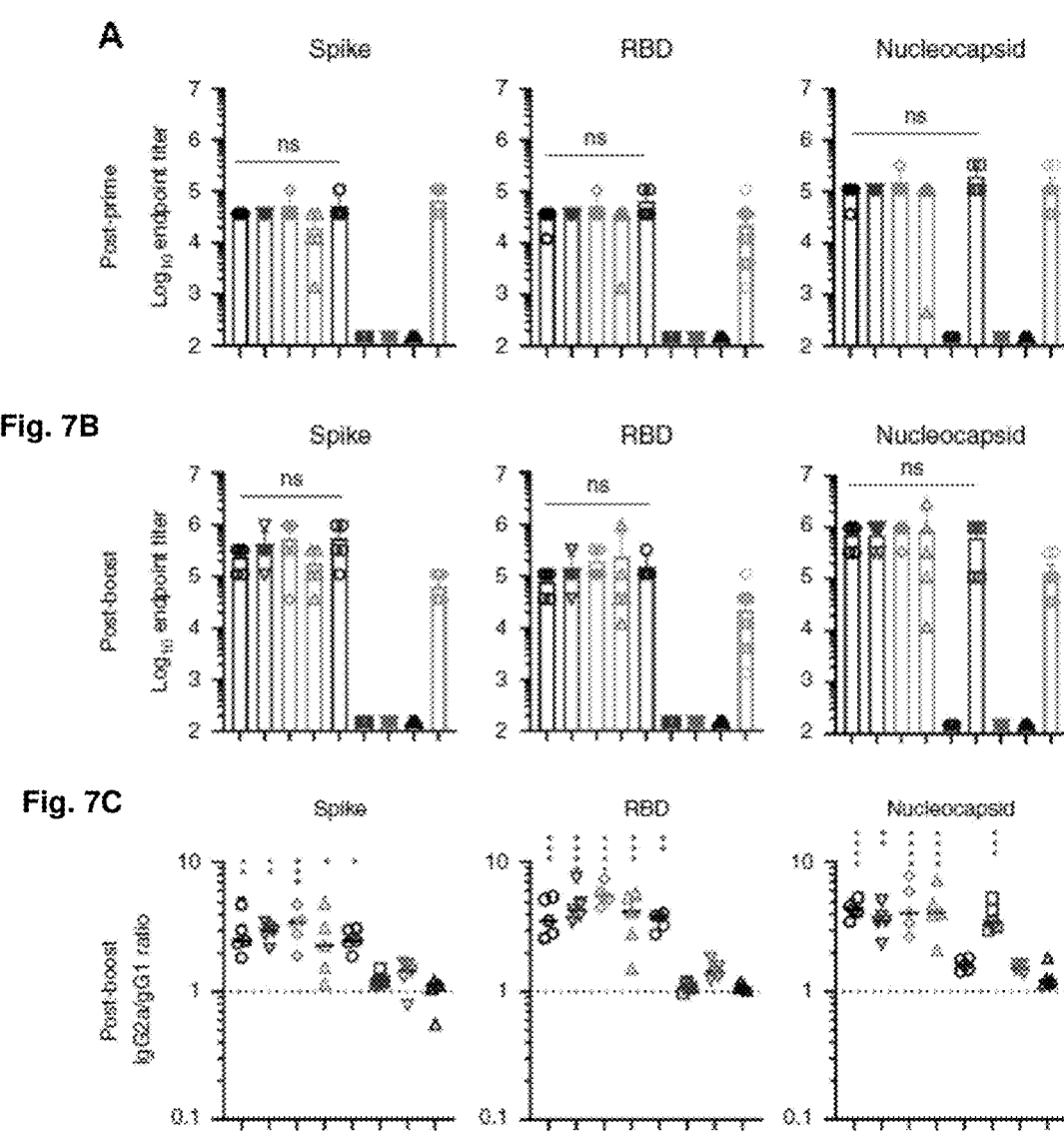
FIGS. 7A-7H demonstrate humoral immune responses stimulated by sMVA-CoV2 vectors. Balb/c mice immunized twice in a three-week interval with 5×10⁷ PFU of the single and double recombinant sMVA-CoV2 vectors derived with FPV HP1.441 (sMVA-S/N hp and sMVA-N/S hp) or TRO-VAC (sMVA-S/N tv, sMVA-N/S tv, sMVA-S tv, sMVA-N tv) were evaluated for SARS-CoV-2-specific humoral immune responses.
Figures 7D, 7E, 7F, 7G, 7H:
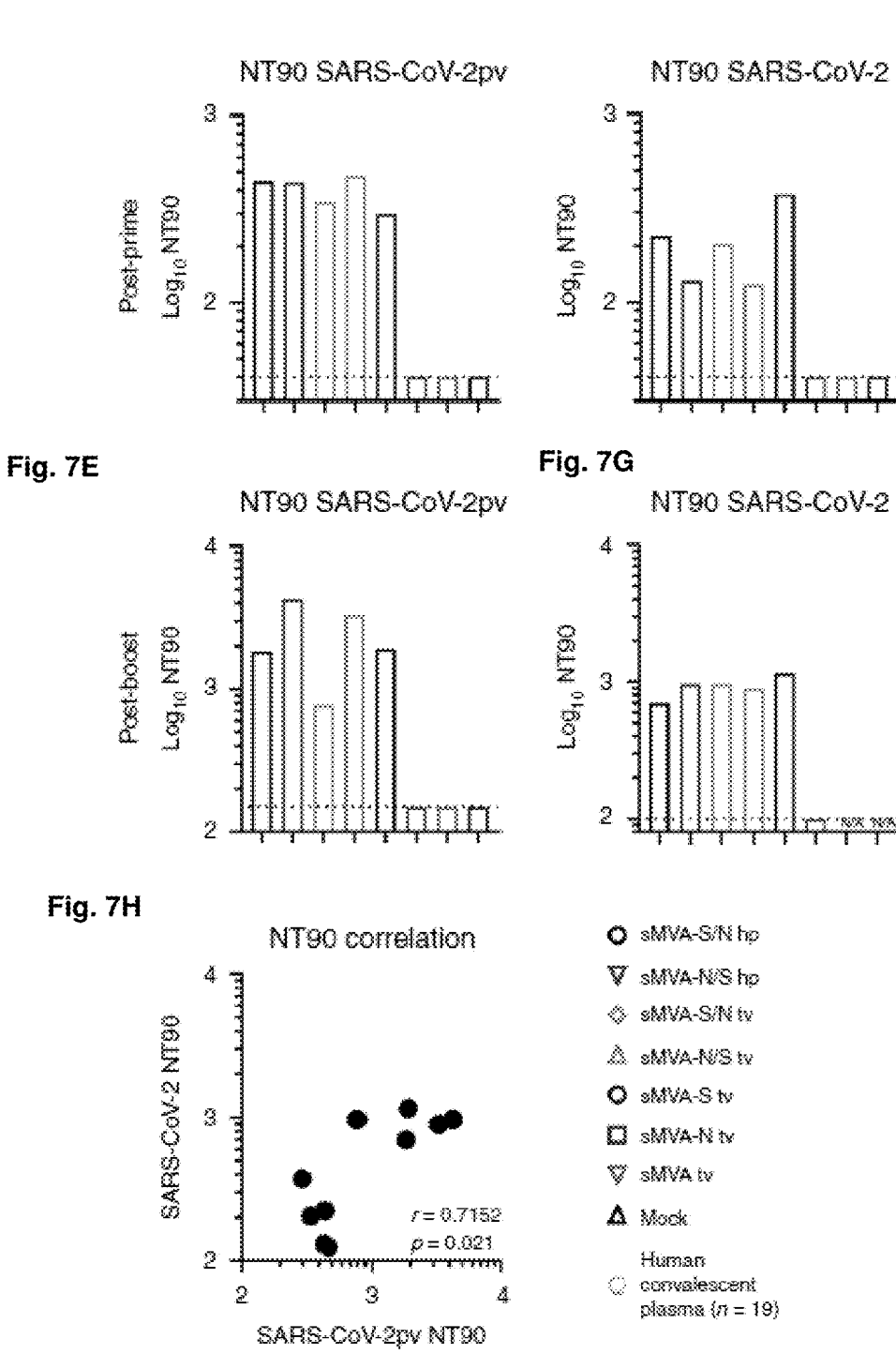
Figures 8A, 8B, 8C:
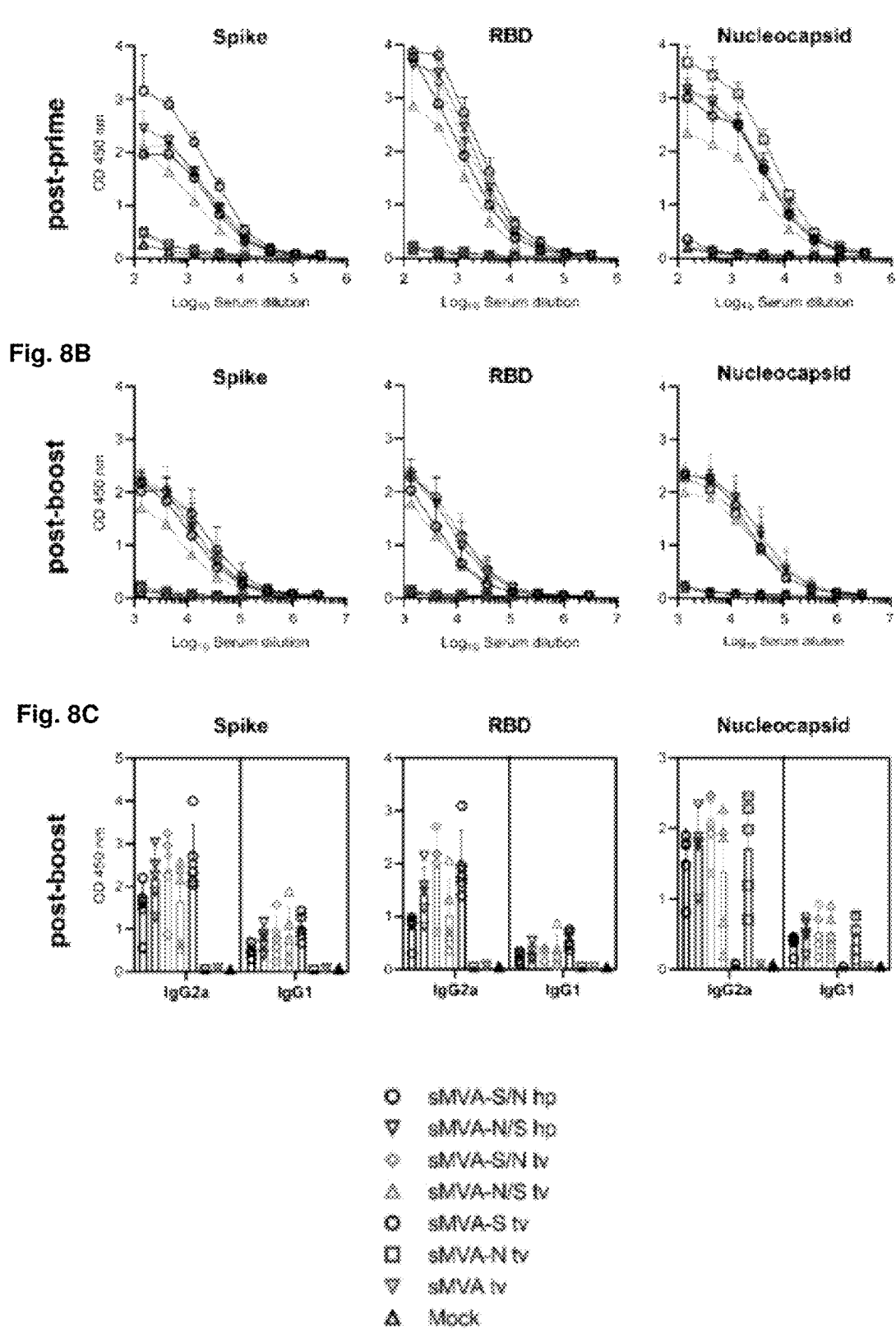
FIGS. 8A-8G demonstrate humoral immune responses induced by the sMVA-CoV2 vectors. Shown are the anti-
Figures 8D, 8E, 8F, 8G:
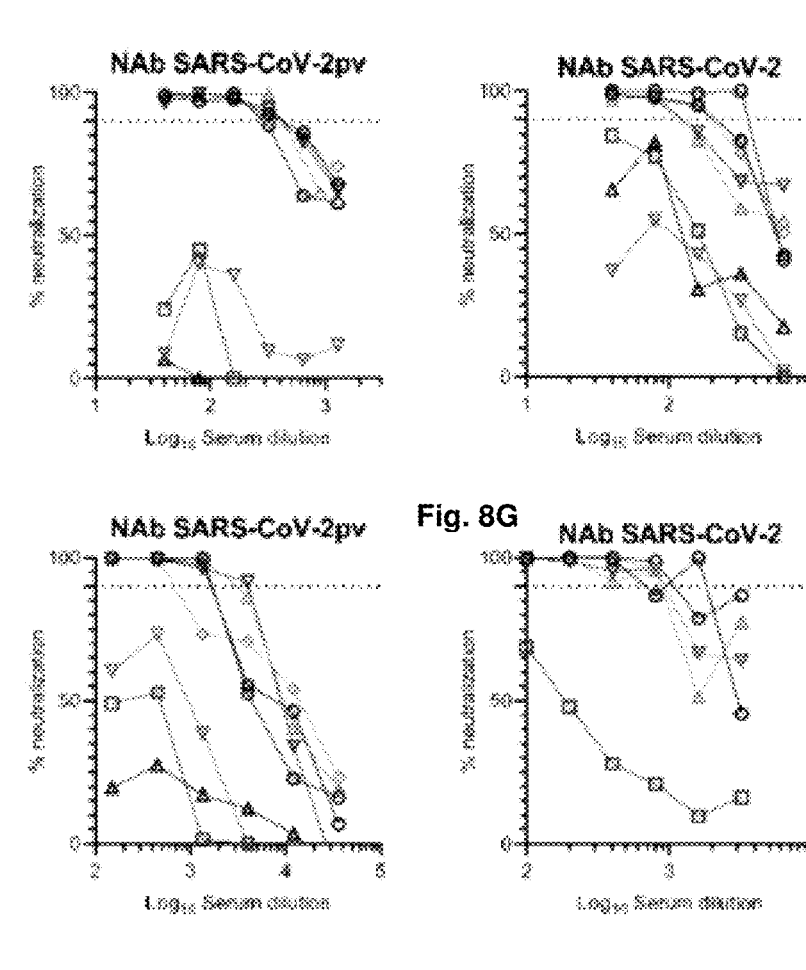

11 body measurements in Balb/c mice (N=5) immunized twice in a three week interval with $5 \times 10^7$ PFU of the single or double recombinant sMVA-CoV2 vectors derived with FPV HP1.441 (sMVA-S/N hp and sMVA-N/S hp) or TROVAC (SMVA-S/N tv, sMVA-N/S tv, sMVA-S tv, sMVA-N tv). FIGS. 8A-8B: Binding antibodies. Shown are S-, RBD-, and N-specific ELISA measurements at 450 nm using serial dilutions of serum collected two weeks post-prime (8A) or one-week post-boost (8B). FIG. 8C: IgG2a/IgG1 isotype ratio. Binding antibodies of the IgG2a and IgG1 isotypes were measured in serum of mice post-boost using a dilution of 1:10,000. FIGS. 8D-8G: NAb responses. Shown is the percent (%) of SARS-CoV-2pv (8D-8E) and infectious authentic SARS-CoV-2 (8F-8G) neutralization measured in sera pooled from each group of immunized mice. Shown is the average % neutralization in duplicate (8D-8E) or triplicate (8F-8G) infection measured at different serum dilutions. Vaccine groups immunized with sMVA tv and PBS (mock) were not included in the analysis shown in 8G because of failure of quality control. Dotted lines mark 90% neutralization that was used to calculate NT90 in FIG. 7.

Figure 9C:
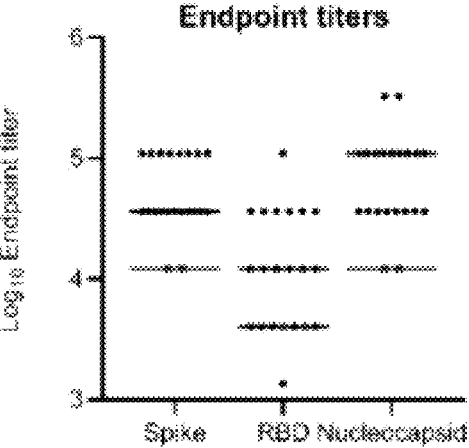

FIGS. 9A-9C demonstrate SARS-CoV-2-specific humoral immune responses in convalescent immune sera. S-, RBD, and N-specific binding antibodies were measured via ELISA using serial dilutions of plasma samples from SARS-CoV-2 convalescent individuals. FIG. 9A: Binding antibody curves from individual samples (N=19). FIG. 9B: SARS-CoV-2 convalescent plasma binding curves were grouped together and compared to binding measured in samples (N=2) from SARS-CoV-2 negative individuals. FIG. 9C: Endpoint binding antibody titers to S, RBD, and N were calculated in individual plasma samples. Lines represent the median endpoint titers. Due to the limited number of SARS-CoV-2-negative samples evaluated, statistical analysis was not performed.

Figure 10A:
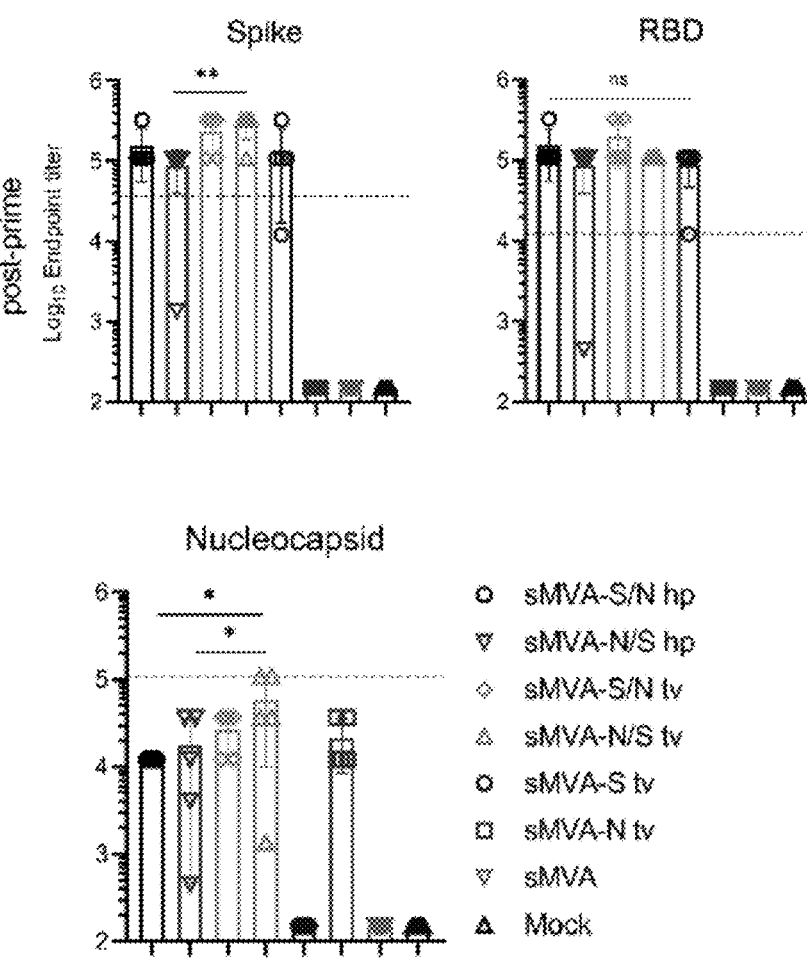
Figure 10C:
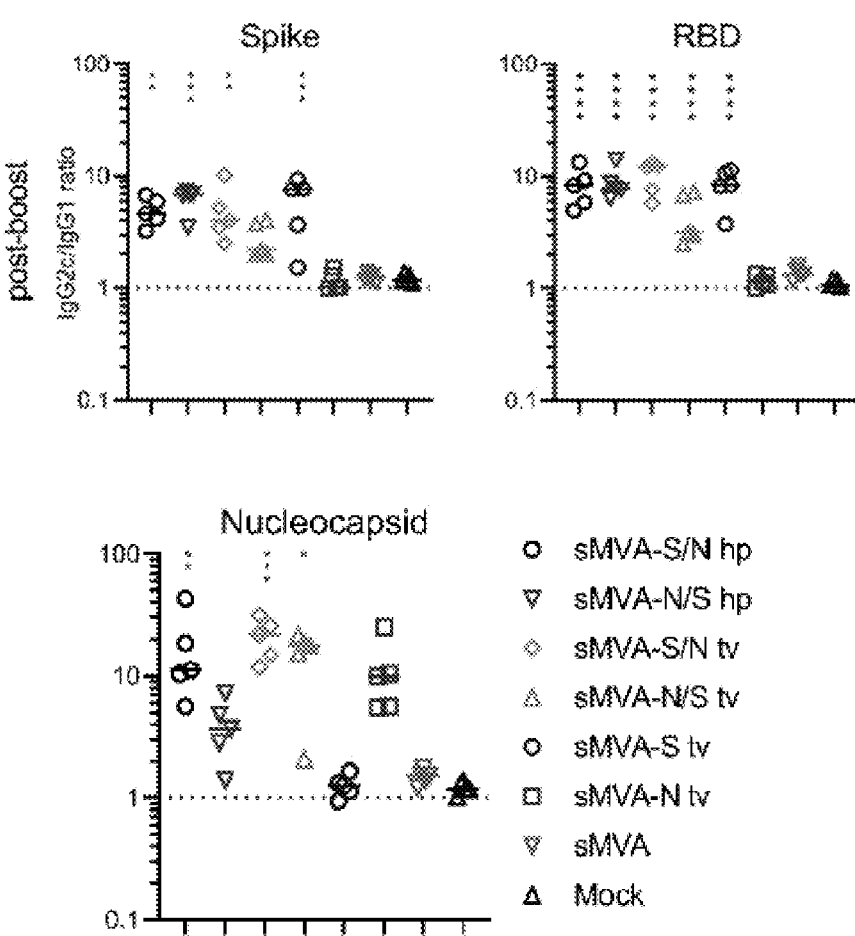

FIGS. 10A-10B demonstrate humoral immune responses induced by sMVA-CoV2 vectors. C57BL/6 Nramp1 mice (N=5) were immunized twice in a three week interval with $5 \times 10^7$ PFU of the single and double recombinant sMVA-CoV2 vectors derived with FPV HP1.441 (sMVA-S/N hp and sMVA-N/S hp) or TROVAC (sMVA-S/N tv, sMVA-N/S tv, sMVA-S tv, sMVA-N tv) and evaluated for SARS-CoV-2-specific humoral immune responses. FIGS. 10A-10B: Binding antibodies. S, RBD, and N-specific binding antibodies induced by the vaccine vectors were evaluated two weeks after the first immunization (10A) and one week after the second immunization (10B) by ELISA. Dashed lines in 10A and 10B indicate median binding antibody endpoint titers that were measured in convalescent human sera (FIG. 9). Data in 10A, and 10B is presented as mean values+/−SD. One-way ANOVA with Tukey's multiple comparison test was used to compare differences between binding antibody end-point titers in mice immunized with different vaccine vectors. FIG. 10C: IgG2c/IgG1 isotype ratio. S-, RBD-, and N-specific binding antibodies of the IgG2c and IgG1 isotype were measured after the second immunization using 1:10, 000 serum dilution, and absorbance reading was used to calculate IgG2c/IgG1 antibody ratio. One-way ANOVA with Dunnett's multiple comparison test was used to compare each group mean IgG2c/IgG1 ratio to a ratio of 1 (balanced Th1/Th2 response). Lines represent median values. $0.05 < p < 0.01$, $0.01 < p < 0.001$, $0.001 < p < 0.0001$, $p < 0.0001$. ns=not significant.

FIG. 11 shows that the immune sera of Balb/c mice immunized with $5 \times 10^7$ PFU of the single and double recombinant sMVA-CoV2 vectors derived with FPV HP1.441 (SMVA-S/N hp and sMVA-N/S hp) or TROVAC (sMVA-S/N tv, sMVA-N/S tv, sMVA-S tv, sMVA-N tv) were evaluated for ADE effects. None of the sMVA-CoV2 vectors induced antibody-dependent enhancement (ADE) of infection, including the parental isolate of the clinical strain COH04S1, sMVA-N/S tv. Neutralizing (1:5,000) and non-neutralizing (1:50,000) dilutions (as assayed on stably-transduced HEK293T cells expressing ACE2 (HEK/ACE2)) were evaluated to promote THP-1 monocyte infection by SARS-CoV-2 pseudovirus (pv) expressing luciferase. VSV-G pv was used as infection control. Relative light units (RLU) were measured in duplicates at 48 hours post infection. Dotted lines represent the negative control (average relative light units (RLU) measured in cells in the absence of pv). Dashed lines represent the positive control (average RLU measured in cells in the absence of serum and in the presence of pv). 2-way ANOVA with Dunnett's multiple comparison test was used to compare each group and serum dilution to the mean RLU in the positive control. ns=not significant; * $p < 0.05$.

FIGS. 12A-12D demonstrate cellular immune responses stimulated by sMVA-CoV2 vectors. Balb/c mice immunized twice in a three-week interval with $5 \times 10^7$ PFU of the single or double recombinant sMVA-CoV2 vectors derived with FPV HP1.441 (sMVA-S/N hp and sMVA-N/S hp) or TRO-VAC (sMVA-S/N tv, sMVA-N/S tv, sMVA-S tv, sMVA-N tv) were evaluated for SARS-CoV-2-specific cellular immune responses. Antigen-specific CD8+ (12A and 12B) and CD4+ (12C and 12D) T cell responses induced by the vaccine vectors after two immunizations were evaluated by flow cytometry for IFNγ, TNFα, IL-4 and IL-10 secretion following ex vivo antigen stimulation using SARS-CoV-2 S and N-specific peptide libraries. Due to technical issues, 1-3 animals/group were not included in the CD4/TNFα analysis in 12C and 12D. One-way ANOVA with Tukey's multiple comparison test was used to compare differences in % of cytokine-specific T-cells between groups. *$p < 0.05$. ns=not significant.

Figure 13A:
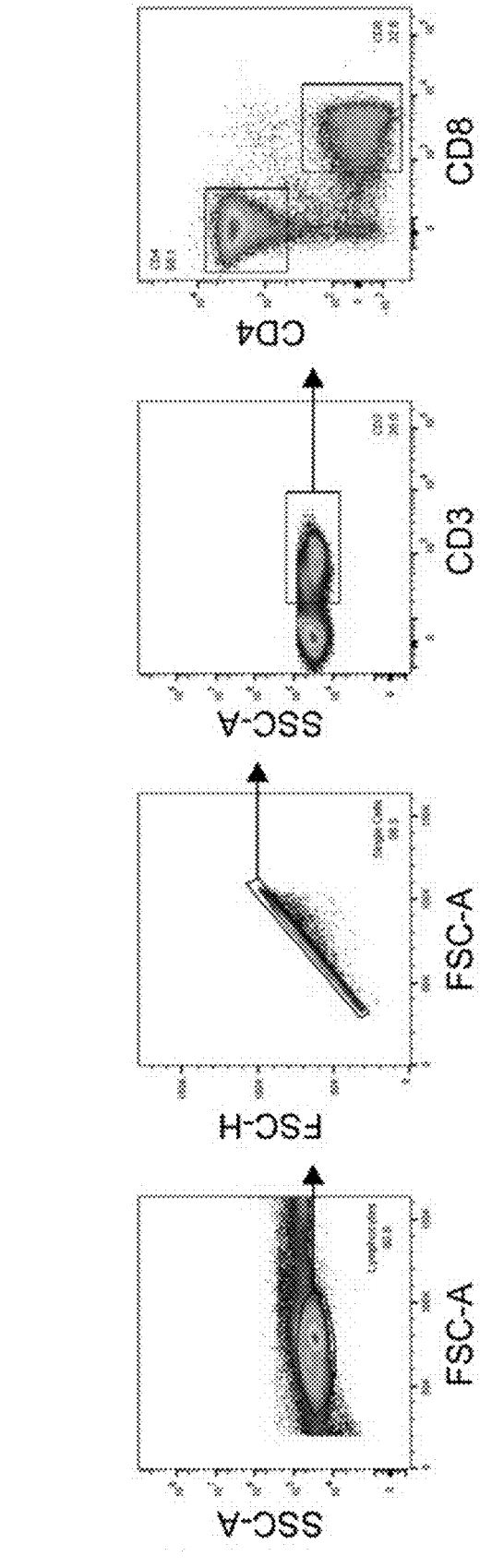
Figure 13B:
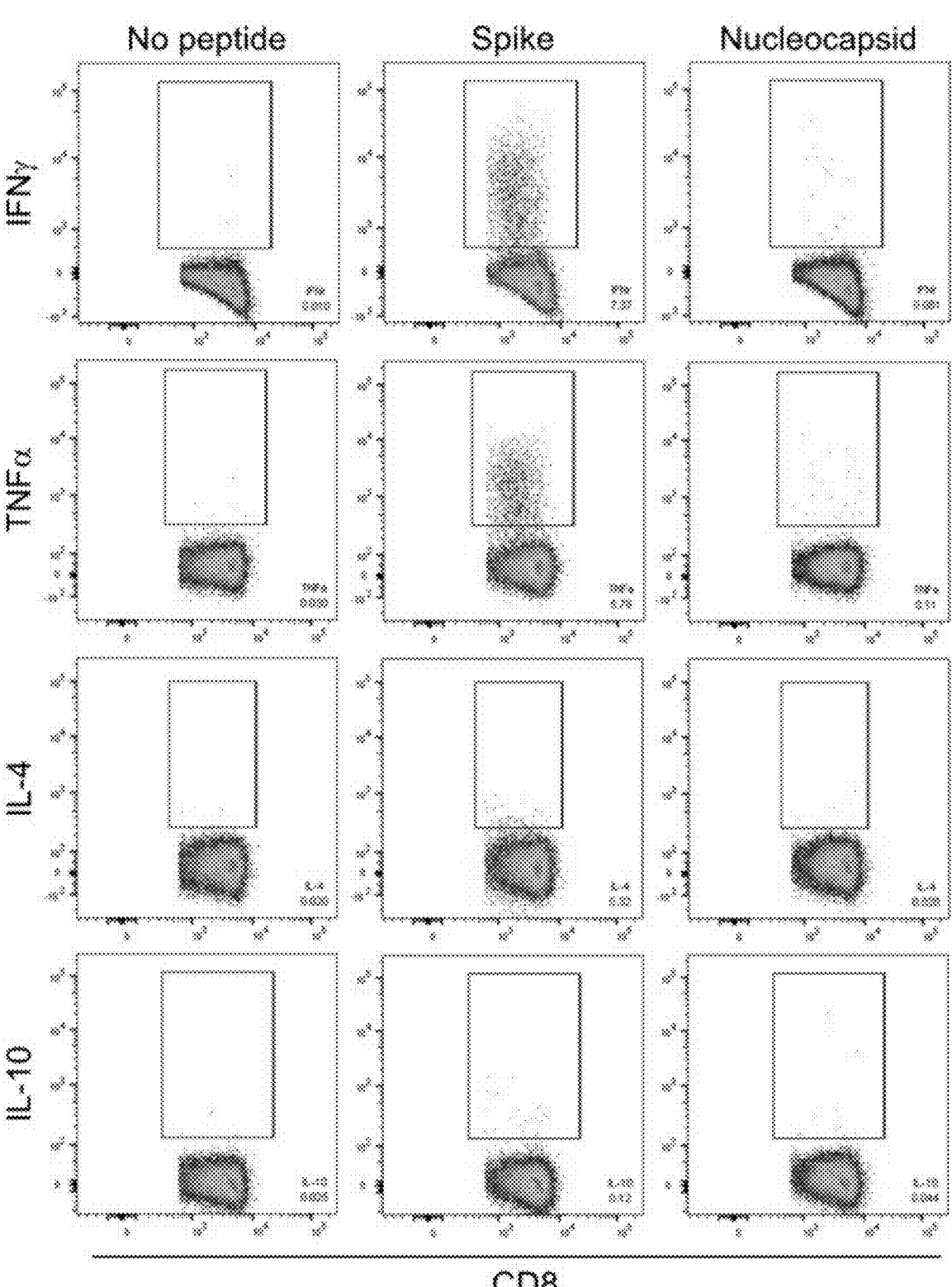
Figure 13C:
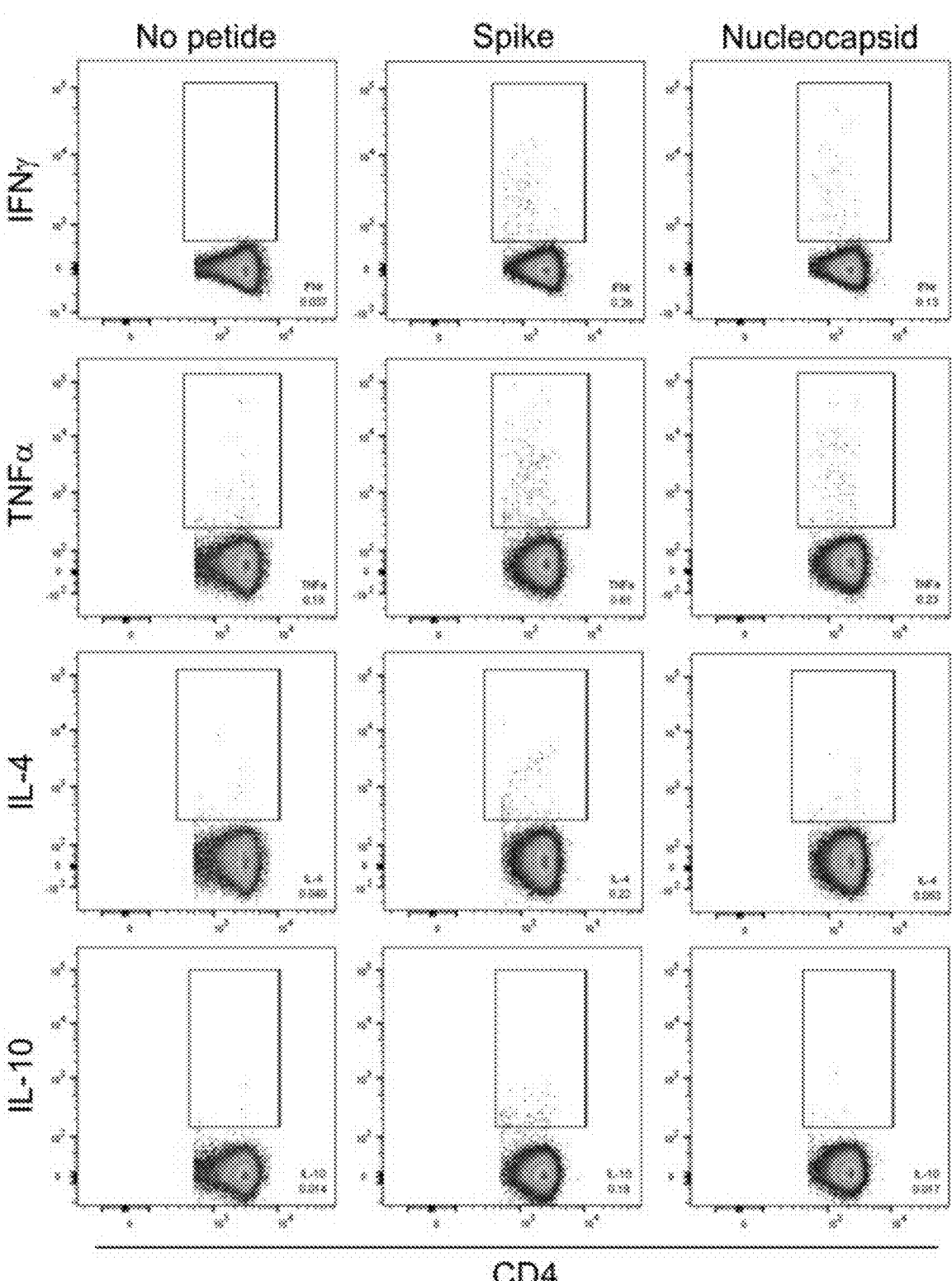

FIGS. 13A-13C show flow cytometry gating strategy. FIG. 13A: Intracellular staining analysis of mouse spleno-cytes stimulated with S and N peptide libraries was performed using a hierarchical gating strategy that included lymphocytes>singlets>CD3+ T-cells>CD4+ T-cells and CD8+ T-cells>Cytokine positive cells. FIGS. 13B-13C: Example of gating on cytokine-positive CD8+ T-cells (13B) and CD4+ T-cells (13C). Splenocytes of a mouse immunized with double recombinant sMVA-CoV2 vector sMVA-N/S were either left untreated (no peptide) or stimulated 16 hours with S or N peptide pools. Numbers in each dot plot indicate the percentage of cells in gated areas.

FIG. 14 shows TNFα secretion by T-cells of sMVA-CoV2-immunized mice. Splenocytes from Balb/c mice immunized with $5 \times 10^7$ PFU of the single and double recombinant sMVA-CoV2 vectors derived with FPV HP1.441 (sMVA-S/N hp and sMVA-N/S hp) or TROVAC (sMVA-S/N tv, sMVA-N/S tv, sMVA-S tv, sMVA-N tv) were evaluated for TNFα secretion. Mouse splenocytes were stimulated with S or N peptide libraries and 48 hours later TNFα was measured by ELISA in cell culture supernatants. Amounts of TNFα quantified in unstimulated samples were subtracted from each peptide-stimulated sample. *$p < 0.05$ compared to mock-immunized mice using one-way ANOVA with Dunnett's multiple comparison test.

Figure 15B:
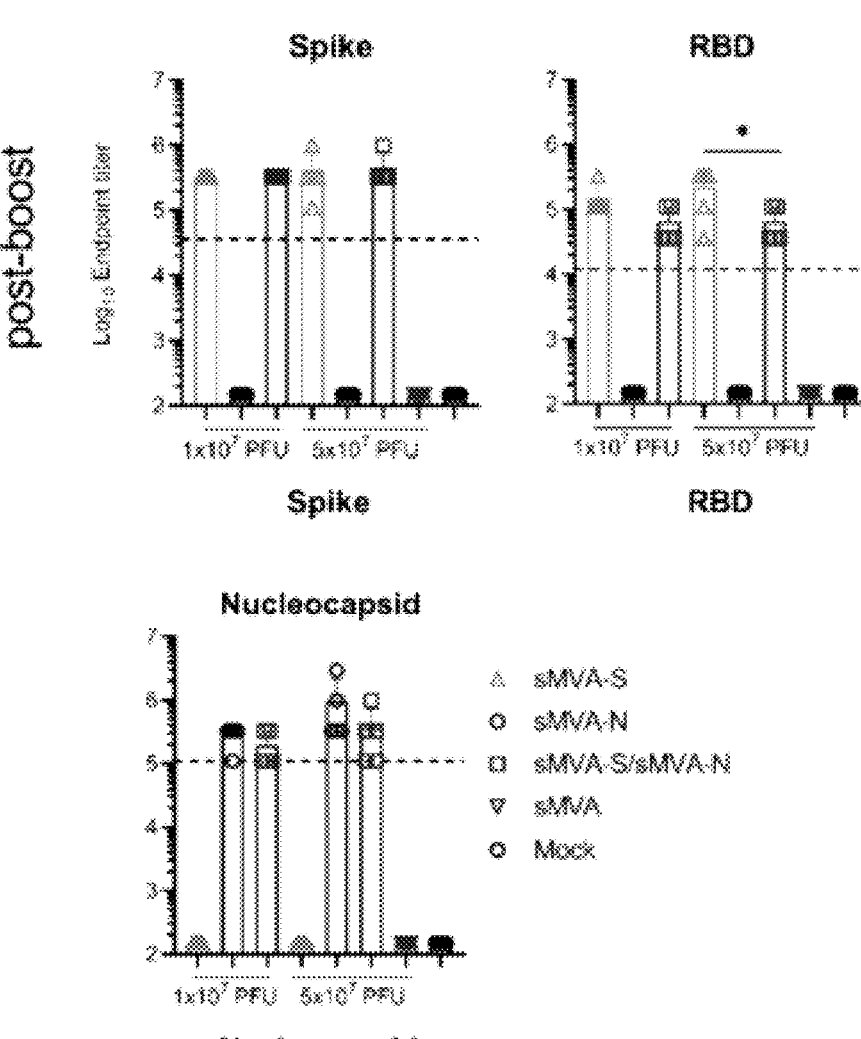
Figure 15D:
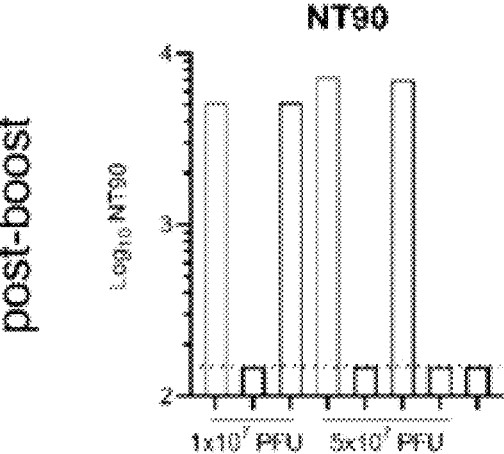
Figure 15E:
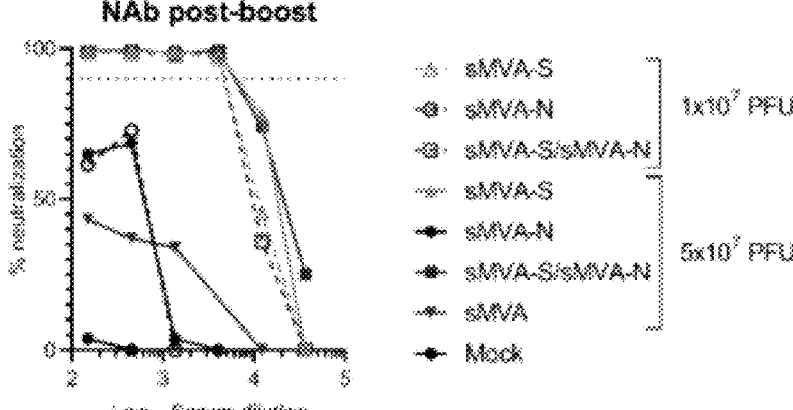

FIGS. 15A-15E demonstrate humoral immune responses induced by sMVA-CoV2 vectors. SARS-CoV-2-specific humoral immune responses were evaluated in mice immunized with the single recombinant sMVA-CoV2 vectors sMVA-S and sMVA-N alone or in combination. Balb/c mice (N=5) were immunized twice in three-week interval with high (5×10⁷ PFU) or low (1×10⁷ PFU) dose of sMVA-S and sMVA-N. Co-immunization via the same immunization schedule with half of the high or low dose of each of the vaccine vectors was evaluated to assess SARS-CoV-2-specific immune stimulation to the S and N antigens by the vectors in combination. Mice immunized with empty sMVA vector or mock-immunized mice were used as controls. FIGS. 15A-15B: Binding antibodies. Antigen-specific binding antibodies to S, RBD, and N were determined after the first and second immunization by ELISA. Dashed lines indicate median binding antibody endpoint titers that were measured in convalescent human sera (FIG. 9). One-way ANOVA with Tukey's multiple comparison test was used to compare differences between binding antibody end-point titers in mice immunized with different vaccine doses, and mice immunized with the vaccine vectors alone or combined. FIG. 15C: IgG2a/IgG1 isotype ratio. Ratio of IgG2a/IgG1 binding antibodies to S, RBD, and N was calculated after performing isotype-specific ELISA for the different antigens using post-boost serum from immunized mice. One-way ANOVA with Dunnett's multiple comparison test was used to compare each group mean to a ratio of 1 (balanced Th1/Th2 response). FIGS. 15D-15E: NAb titers. SARS-CoV-2-specific NAb responses were measured after the second immunization in pooled sera by neutralization assay using SARS-CoV-2 pseudovirus. Shown in FIG. 15D are the neutralizing antibody titers to prevent 90% infection of SARS-CoV-2 pseudovirus (NT90). Dotted baseline represents the minimum dilution included in the analysis. Groups with NT90<baseline are shown at baseline. E shows % neutralization measured using serial dilutions of pooled sera. Dotted line in E marks 90% neutralization. * p<0.05.

Figure 16A:
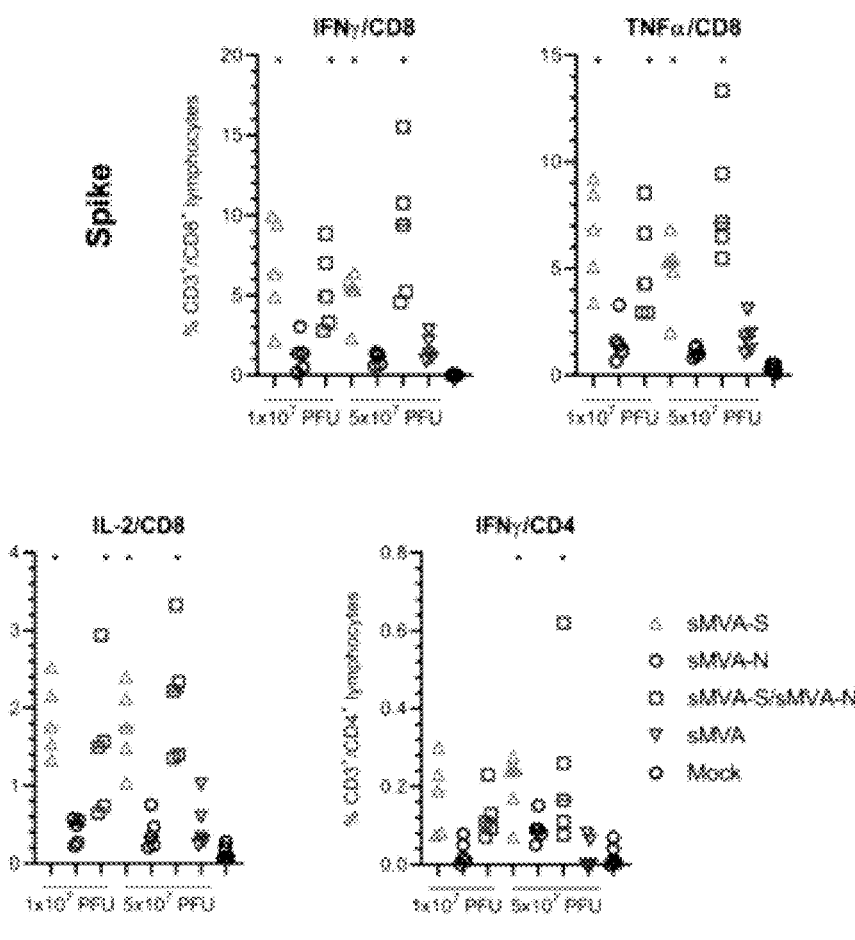

FIGS. 16A-16B demonstrate cellular immune responses in vivo immunogenicity of sMVA-CoV2 vectors. SARS-CoV-2-specific cellular immune responses were evaluated in mice immunized with sMVA-CoV2 single recombinant vectors sMVA-S and sMVA-N alone or in combination. Balb/c mice (N=5) were immunized twice in three-week interval with high (5×10⁷ PFU) or low (1×10⁷ PFU) dose of sMVA-CoV2 single recombinant sMVA-S and sMVA-N. Co-immunization via the same immunization schedule with half of the high or low dose of each of the vaccine vectors was evaluated to assess SARS-CoV-2-specific immune stimulation to the S and N antigens by the vaccine vectors in combination. Mice immunized with empty sMVA vector or mock-immunized mice were used as controls. Antigen-specific CD8+ T cells expressing IFNγ, TNFα, and IL-2 and CD4+ T cell expressing IFNγ were evaluated by flow cytometry staining following ex vivo antigen stimulation using SARS-CoV-2-specific S and N peptide libraries. One-way ANOVA followed by Dunnett's multiple comparison test was used to compare each group mean to the mean in mock-immunized mice. * p<0.05. ns=not significant.

Figure 17:
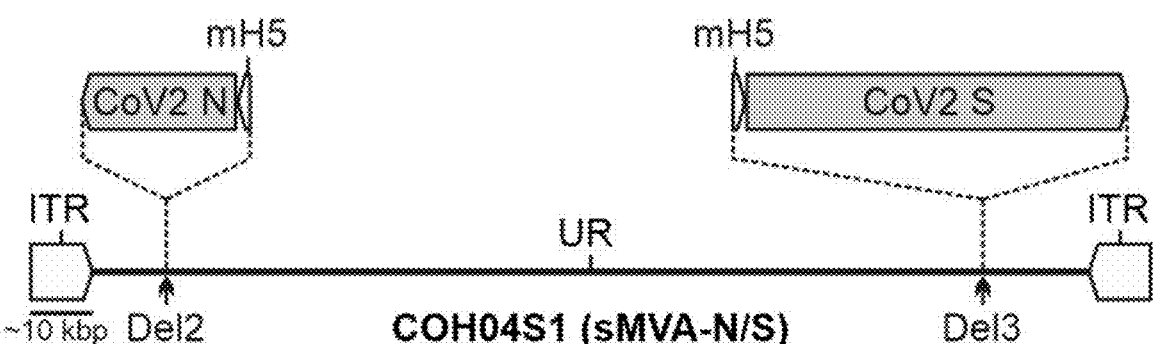

FIG. 17 illustrates SARS-CoV-2 clinical candidate vaccine COH04S1, a synthetic MVA viral vector-based vaccine expressing SARS-CoV-2 S and N antigens (SMVA-N/S). The gene sequences encoding the S and N antigens are inserted into the Del3 and Del2 insertions sites as indicated. mH5=modified Vaccinia H5 promotor; ITR=inverted terminal repeats; UR=internal unique region.

Figure 18:
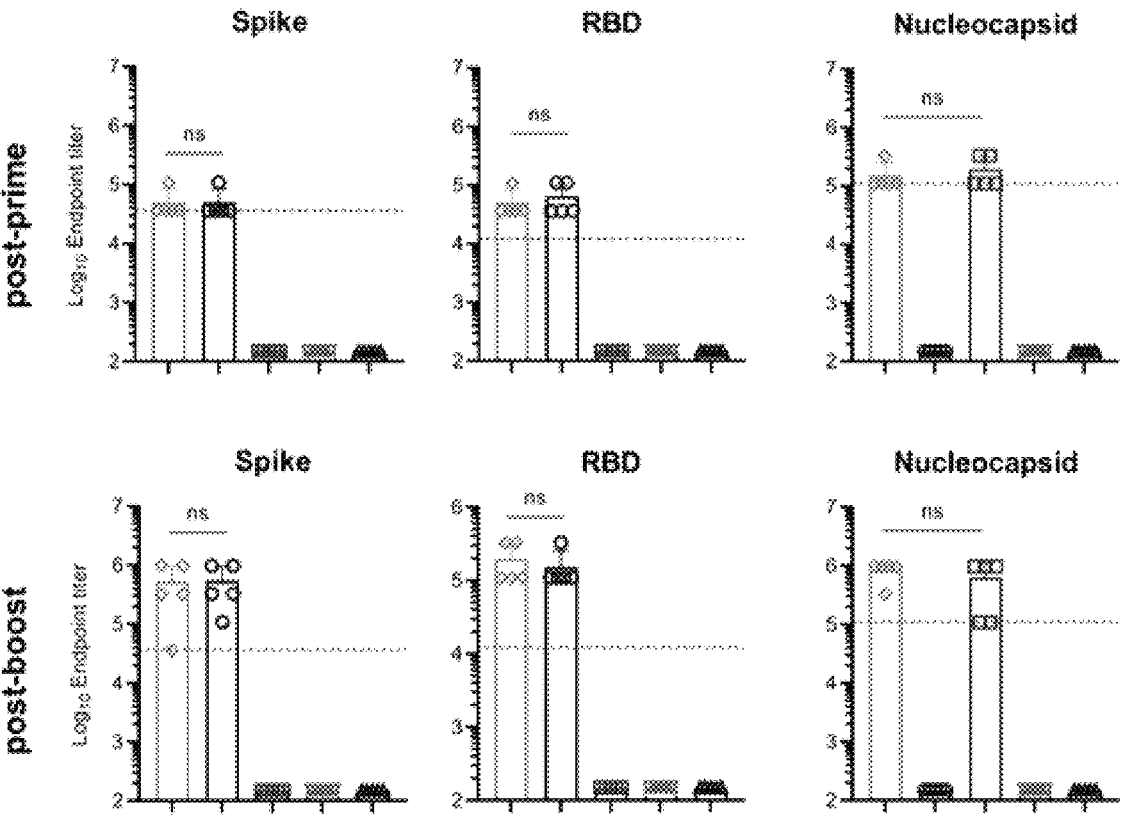

FIG. 18 demonstrates that C46 (a.k.a. sMVA-S/N) induced potent binding antibody responses against SARS-COV-2 in preclinical rodent models. Dashed lines indicate median binding antibody endpoint titers measured in convalescent human sera. The diamonds represent C46 (a.k.a. sMVA-S/N), which is the sMVA-CoV2 double recombinant vaccine expressing both Spike and Nucleocapsid antigens. The circles represent sMVA-S, which is the single recombinant sMVA with Spike antigen only. The squares represent sMVA-N, which is the sMVA-CoV2 single recombinant with Nucleocapsid antigen only. The inverted triangles represent sMVA viral vector without SARS-COV-2 antigens. The triangles represent mock vaccination.

Figure 19:
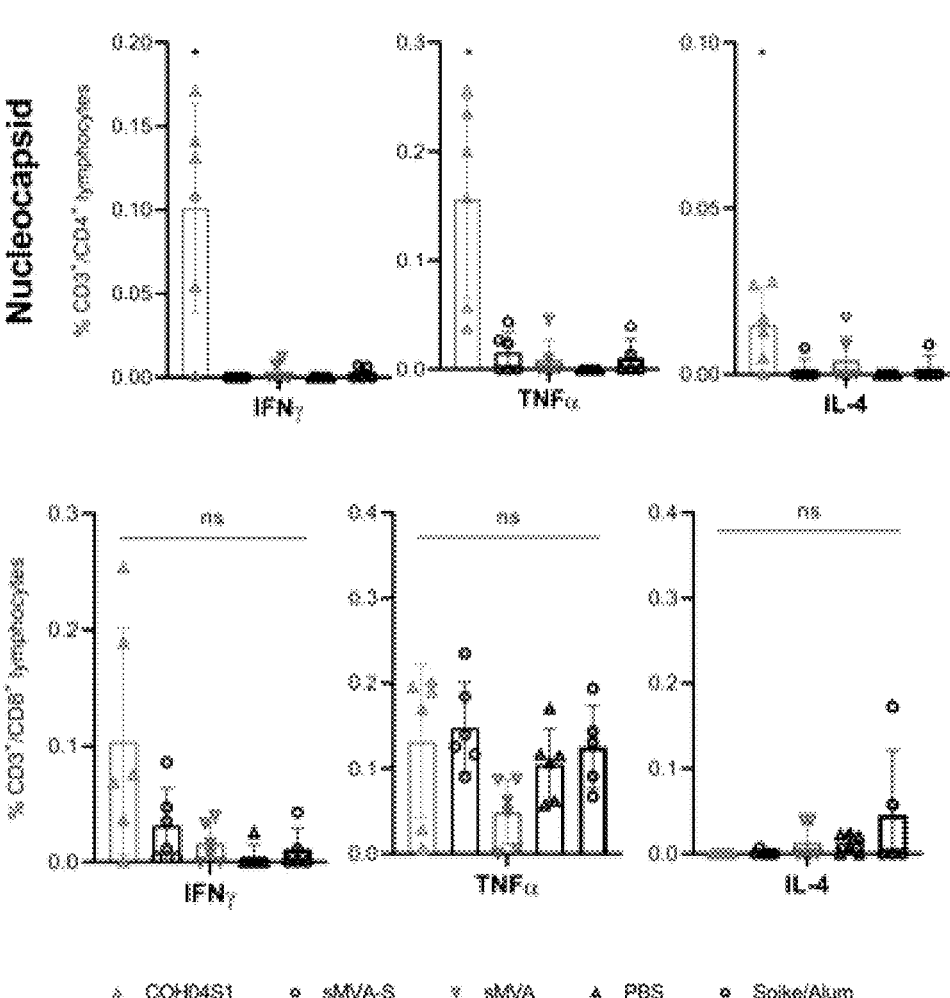

FIG. 19 demonstrates clinical candidate COH04S1 induced potent cellular (T Cell) immune responses in preclinical rodent models. Spike- and Nucleocapsid-specific IFNγ, TNFα, and IL-4 CD8+ and CD4+ responses induced by COH04S1 (C35, sMVA-N/S) were compared to responses induced by an sMVA-CoV2 single recombinant vaccine expressing only Spike (sMVA-S), empty control sMVA, mock immunized animals, and mice immunized with Spike admixed to Alum. COH04S1 clinical candidate induced robust Spike- and Nucleocapsid T cell responses.

FIG. 20 demonstrates humoral and cellular responses in C35 (sMVA-N/S) vaccinated mice indicating a Th1-response. Humoral and cellular responses in BALB/c mice immunized with clinical candidate COH04S1 (sMVA-N/S) were compared to responses induced by an sMVA expressing only Spike (sMVA-S), empty control sMVA, mock immunized animals, and mice immunized with Spike admixed to Alum. Spike/Alum immunized animals develop Th2 responses following vaccination as shown by IgG1 biased antibody responses and IL-4 biased T cell responses. Clinical candidate COH04S1 (SMVA-N/S) immunized mice presented a Th1 shifted humoral and cellular response.

Figure 21:
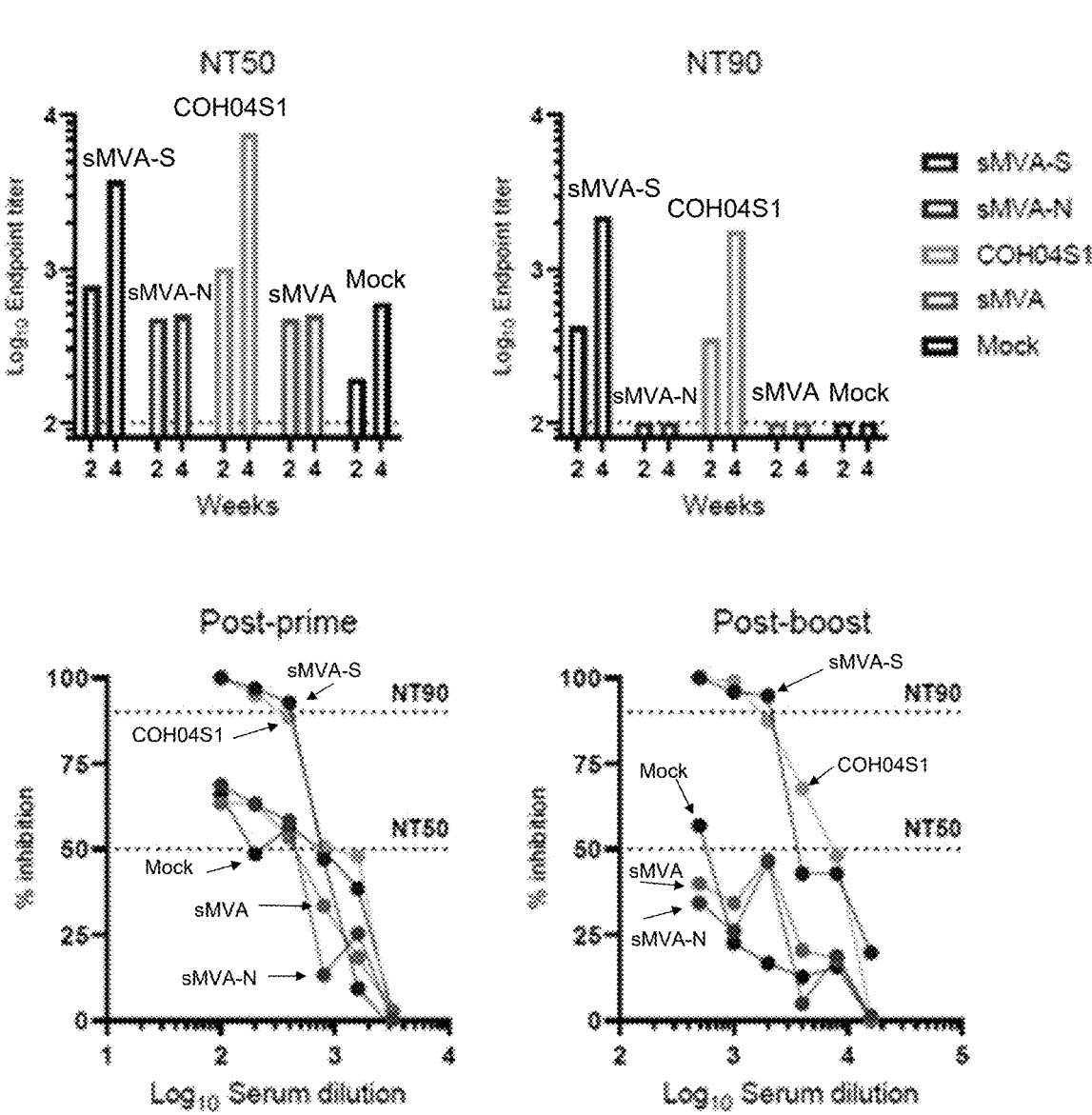

FIG. 21 demonstrates clinical candidate COH04S1 induced potent SARS-CoV-2 neutralizing antibody response in preclinical rodent models using live SARS-CoV-2 in a plaque reduction assay on HeLa-ACE2 cells. *NT50/90 is the dilution of the (antibody-containing) serum showing 50/90% neutralization of infection.

Figure 22:
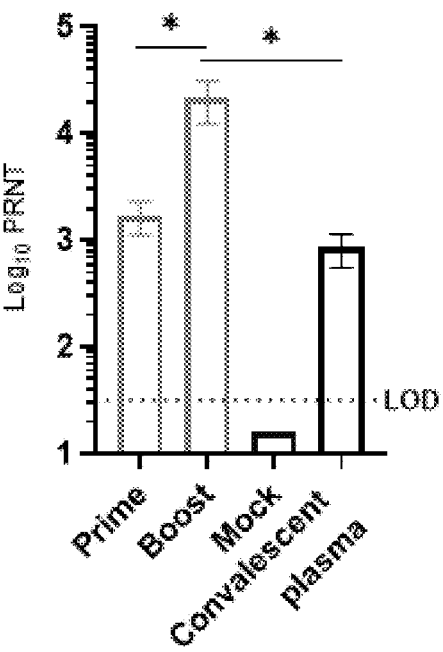

FIG. 22 demonstrates clinical candidate COH04S1 elicited potent SARS-CoV-2-specific neutralizing antibodies (NAb) in mice using authentic SARS-CoV-2 virus on susceptible cells (VeroE6). Clinical candidate COH04S1-primed and prime-boosted mice serum was analyzed for neutralization of live SARS-CoV-2 and compared to neutralization in a pool of 35 human plasma samples from individuals with mild-to-severe SARS-CoV-2 infection.

FIG. 23 shows that the SARS-CoV2 vaccines based on sMVA did not induce antibody-dependent enhancement (ADE) of infection.

FIG. 24 shows that COH04S1 induced strong immune responses in mice following intraperitoneal (IP) and intranasal (IN) vaccinations. Clinical candidate COH04S1 was used to immunize Balb/c mice IP or IN. Clinical candidate COH04S1-induced responses were compared to humoral and cellular responses induced by Spike and Nucleocapsid proteins admixed with Alum. Antibody responses post-prime and post-boost were evaluated by IgG and IgA RBD-ELISA and authentic SARS-CoV-2 virus neutralization assay. T cell responses were evaluated by IFNγ-ELISPOT after stimulation of splenocytes with S- and N-specific peptide libraries.

FIGS. 25A-25D show CD8+ T-cell responses induced by SARS-CoV2 sMVA construct sMVA-N/S in HLA transgenic mice. HLA-B*07:02 (B7) transgenic mice (n=4) were immunized twice in a 3-week interval with 1×10⁷ PFU of SARS-CoV2 sMVA construct SMVA-N/S or sMVA control vector (reconstituted with FPV TROVAC). B7 mice (n=3) were mock-immunized as additional control. Development of SARS-CoV-2-specific CD8+ T cells was evaluated one week post booster immunization. FIGS. 25A-25D show intracellular cytokine staining. Nucleocapsid- (25A and 25C) and Spike-specific (25B and 25D) CD8+ T cells were evaluated by intracellular cytokine staining for IFNγ, TNFα, and IL-4 secretion following ex vivo antigen stimulation by N and S peptide libraries, respectively. Panels 25A and 25B show the percentage of CD3+/CD8+ T cells secreting IFNγ, TNFα, or IL-4 following peptide stimulation. Panels 25C and 25D show relative frequencies of CD8+ T cells secreting one or more cytokines after peptide stimulation. Total percentage of cytokine-secreting cells within CD3+/CD8+ population is indicated under each pie chart. One-way ANOVA with Dunnett's multiple comparison test was used in 25A and 25B. Data in 25A and 25B are presented as mean values±SD; *$0.05 < p < 0.01$, $0.01 < p < 0.001$, *$0.001 < p < 0.0001$, ****$p < 0.0001$; ns=not significant.

Figure 26:
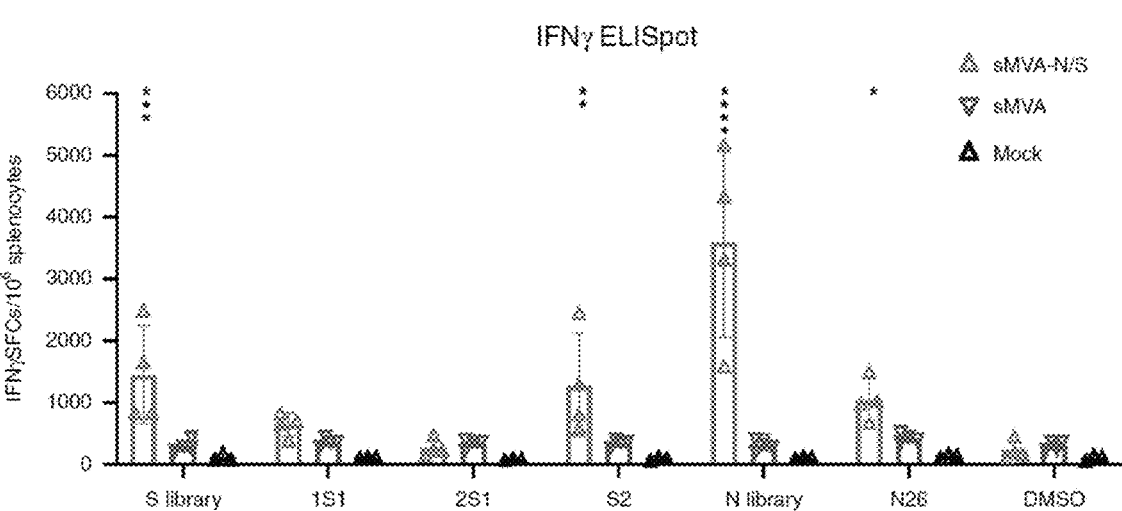

FIG. 26 shows T cell responses in HLA-B*07:02 (B7) transgenic mice immunized with clinical candidate COH04S1 (SMVA-N/S). ELISPOT analysis of IFNγ-secreting cells was performed following stimulation with S and N peptide libraries, S library sub-pools (1S1, 2S1, S2), and N26 peptide containing the HLA-B*07:02-restricted N-specific immunodominant epitope SPRWYFYYL (SEQ ID NO: 89). Two-way ANOVA with Dunnett's multiple comparison test was used. Data is presented as mean values±SD; *$0.05 < p < 0.01$, $0.01 < p < 0.001$, *$0.001 < p < 0.0001$, ****$p < 0.0001$; ns=not significant.

FIG. 27 shows that aged mice developed comparable immune responses to young mice following prime-boost immunization with clinical candidate COH04S1. Clinical candidate COH04S1 was used to immunized young (8 weeks old), middle aged (40 weeks old), and aged (80 weeks old) C57BL/6 mice. Control animals were mice of similar age immunized with Spike and Nucleocapsid proteins admixed with Alum, and mock-immunized animals. Neutralizing antibodies were evaluated using SARS-CoV-2 Spike pseudovirus on HEK-293/Ace2 cells. T cell responses were measured using mouse IFNγ ELISPOT assay after stimulating mouse splenocytes with Spike peptide subpools (1S1, 2S1 and S2), and N peptides.

FIG. 28 shows the immunogenicity of clinical candidate COH04S1. COH04S1 shows comparable immunogenicity between sexes in Balb/C mice and demonstrates Th1 immunity compared to S/N/Alum to all antigens.

FIG. 29 illustrates the hamster clinical candidate COH04S1 vaccine study design.

FIG. 30 shows titers of binding antibodies induced by sMVA-SARS-CoV-2 vectors and clinical candidate COH04S1 clinical candidate in hamsters after intramuscular (IM) or intranasal (IN) immunization with 1×10^8 pfu of sMVA-CoV2 vaccine constructs. The sMVA-CoV2 vaccines used in the study were: C79 (S2P/N double recombinant with 2P Spike sequence); clinical candidate COH04S1 (C35/F4/B1, double plaque purified isolate of C35 double recombinant); C35/F4/D5 (double plaque purified isolate of C35 double recombinant); C46/C3/F10 (double plaque purified isolate of C46 double recombinant); C15 (single recombinant expressing Spike only); C35 (double recombinant, and parental clone of COH04S1 clinical isolate). The sMVA empty vector was used as a control.

FIG. 31 shows neutralizing antibodies (PRNT) induced by sMVA-SARS-CoV-2 vectors and COH04S1 clinical candidate in hamsters measured at day 42. The hamsters were primed at day zero and boosted at day 28 with 1×10^8 pfu of clinical candidate COH04S1 or sMVA-SARS-CoV-2 vectors intramuscularly or intranasally. Empty vector sMVA-immunized hamsters were used as a control. Antibodies neutralizing authentic SARS-CoV-2 virus were measured in vitro using Vero cells. PRNT assay was done at Bioqual (Gaithersburg, MD) using SARS-CoV-2, Isolate USA-WA1/2020. Day 42 serum samples were used for the analysis.

Figure 32:
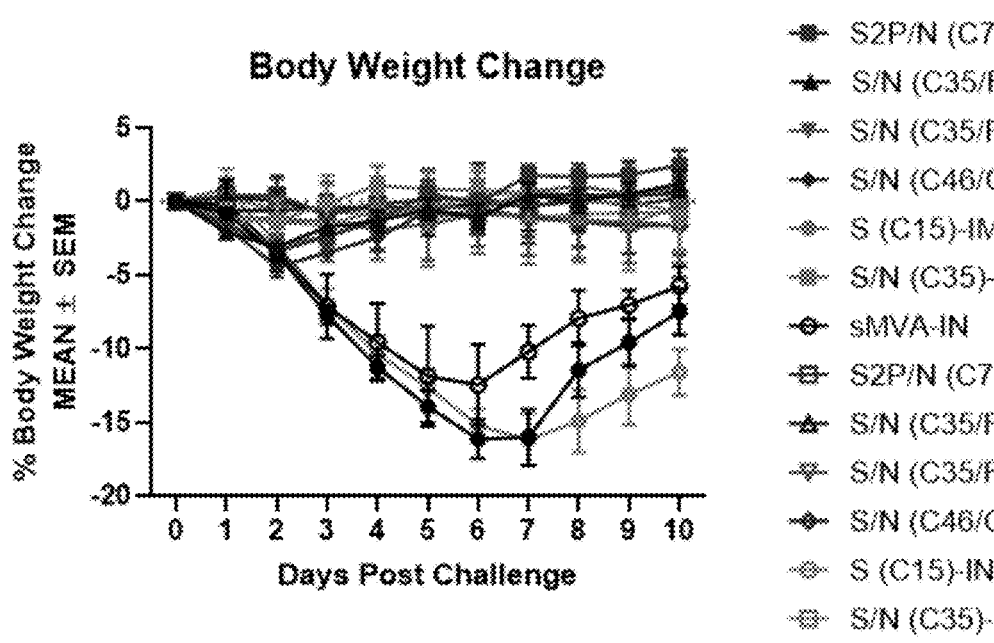

FIG. 32 shows body weight change of the hamsters which were immunized with sMVA-CoV2 vectors or COH04S1 and were challenged two weeks post-boost with 6×10^4 pfu of authentic SARS-CoV-2 virus, Isolate USA-WA1/2020. The weight changes were measured daily for 10 days. All sMVA-CoV2 vectors including COH04S1 prevented severe weight loss in challenged animals.

Figure 33:
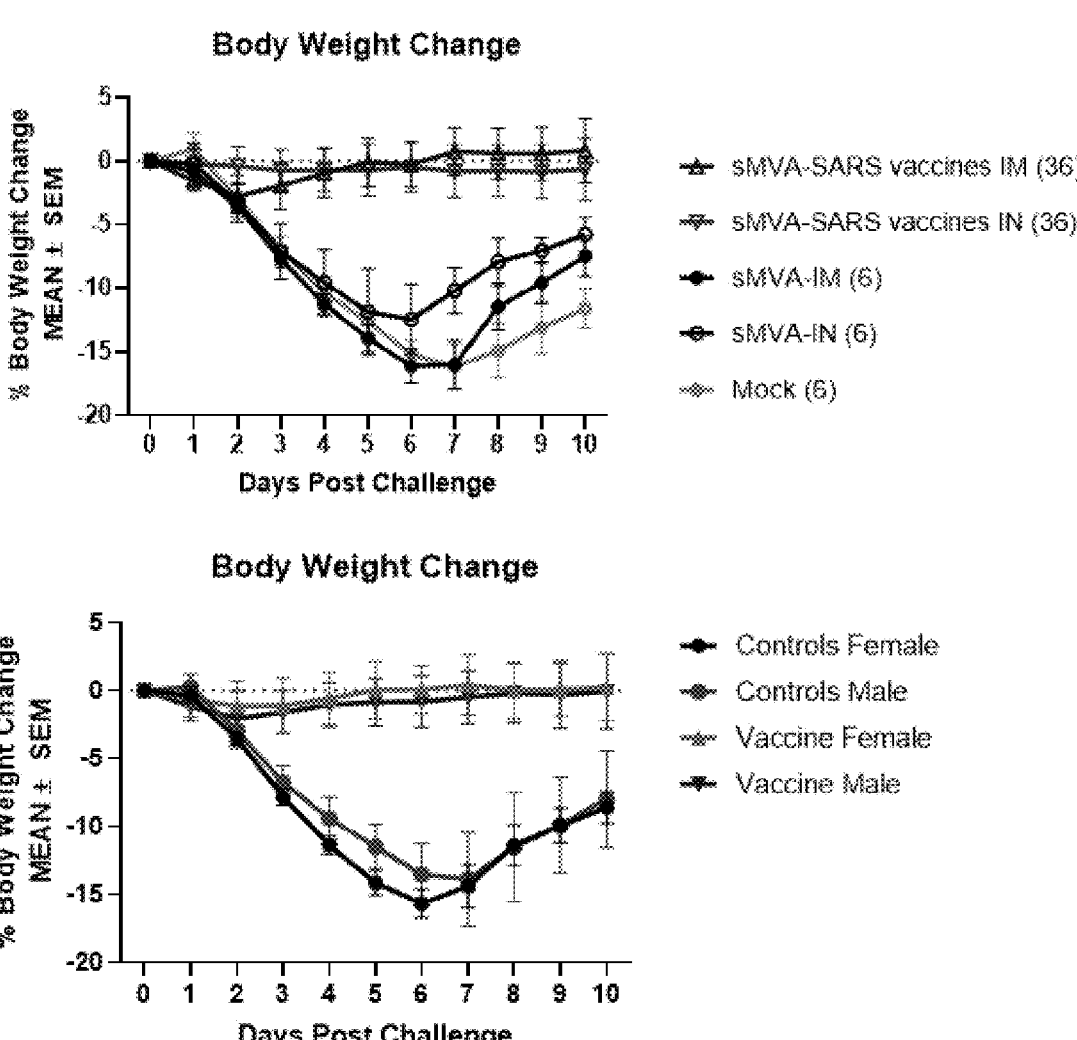

FIG. 33 shows body weight change of the hamsters immunized with sMVA-CoV2 vectors either intramuscularly or intranasally and which were challenged two weeks post-boost with 6×10^4 pfu of authentic SARS-CoV-2 virus, Isolate USA-WA1/2020. The weight changes were measured daily for 10 days. The animals were grouped by immunization route (top) or sex (bottom).

Figure 34:
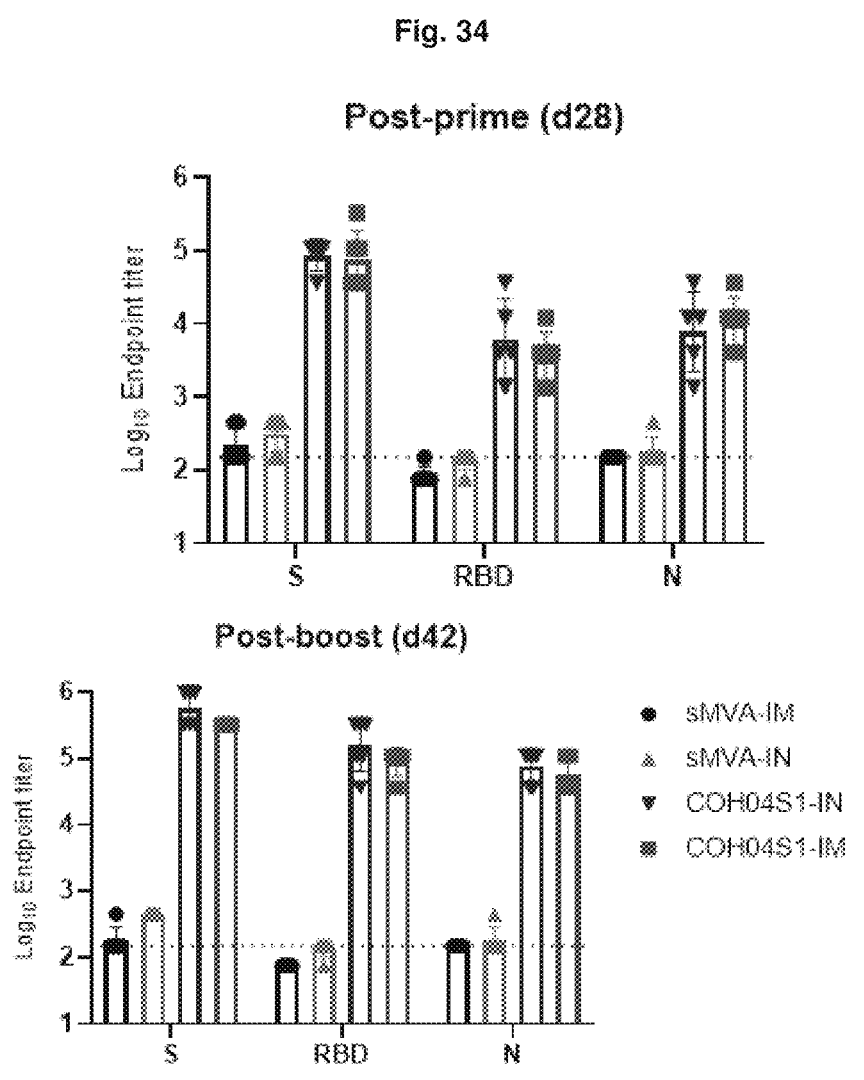

FIG. 34 shows binding antibodies and neutralizing antibodies induced by clinical candidate COH04S1 in hamsters. The hamsters were primed at day zero and boosted at day 28 with 1×10^8 pfu of clinical candidate COH04S1 intramuscularly or intranasally. Empty vector sMVA-immunized hamsters were used as a control. Shown are endpoint binding antibody titers (total IgG) to Spike, RBD and Nucleocapsid measured in immunized hamsters post-prime (day 28) and post-boost (day 42). Ratios of IgG2/3 and IgG1 immunoglobulin titer to Spike, RBD, and Nucleocapsid are shown and are indicative of a Th1-biased response in clinical candidate COH04S1-immunized hamsters. The serum antibodies neutralizing authentic SARS-CoV-2 virus were measured in vitro using Vero cells. PRNT assay was done at Bioqual using SARS-CoV-2, Isolate USA-WA1/2020. Day 42 serum samples were used for the analysis.

FIG. 35 shows successful protection of clinical candidate COH04S1-vaccinated hamsters from sub-lethal challenge with authentic SARS-CoV-2 virus. The hamsters were challenged two weeks post-boost with SARS-CoV-2, Isolate USA-WA1/2020 and the weight changes were measured daily for 10 days. Thick lines indicate median weight loss values. Thin lines indicate single animals' weight loss.

Figure 36A:
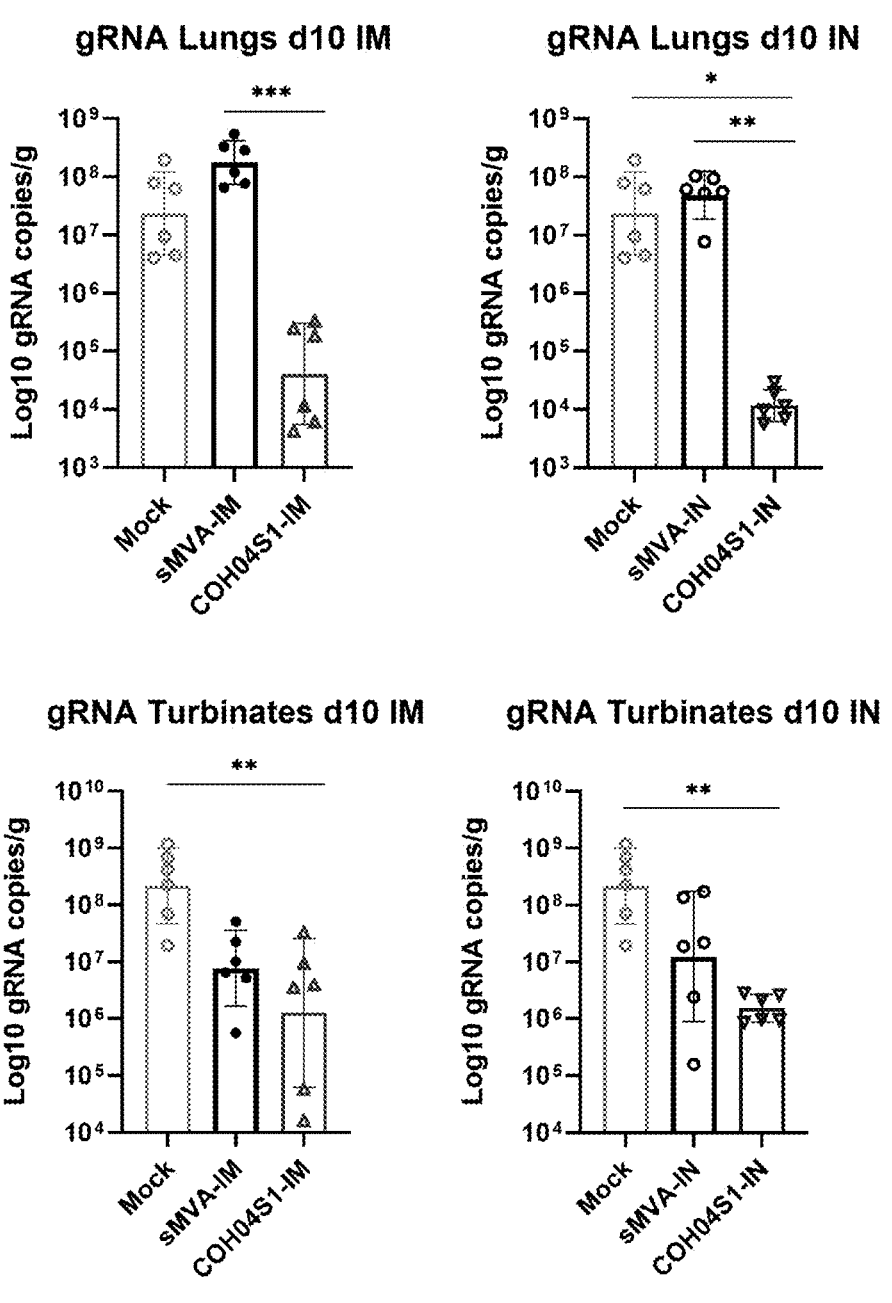
Figure 36B:
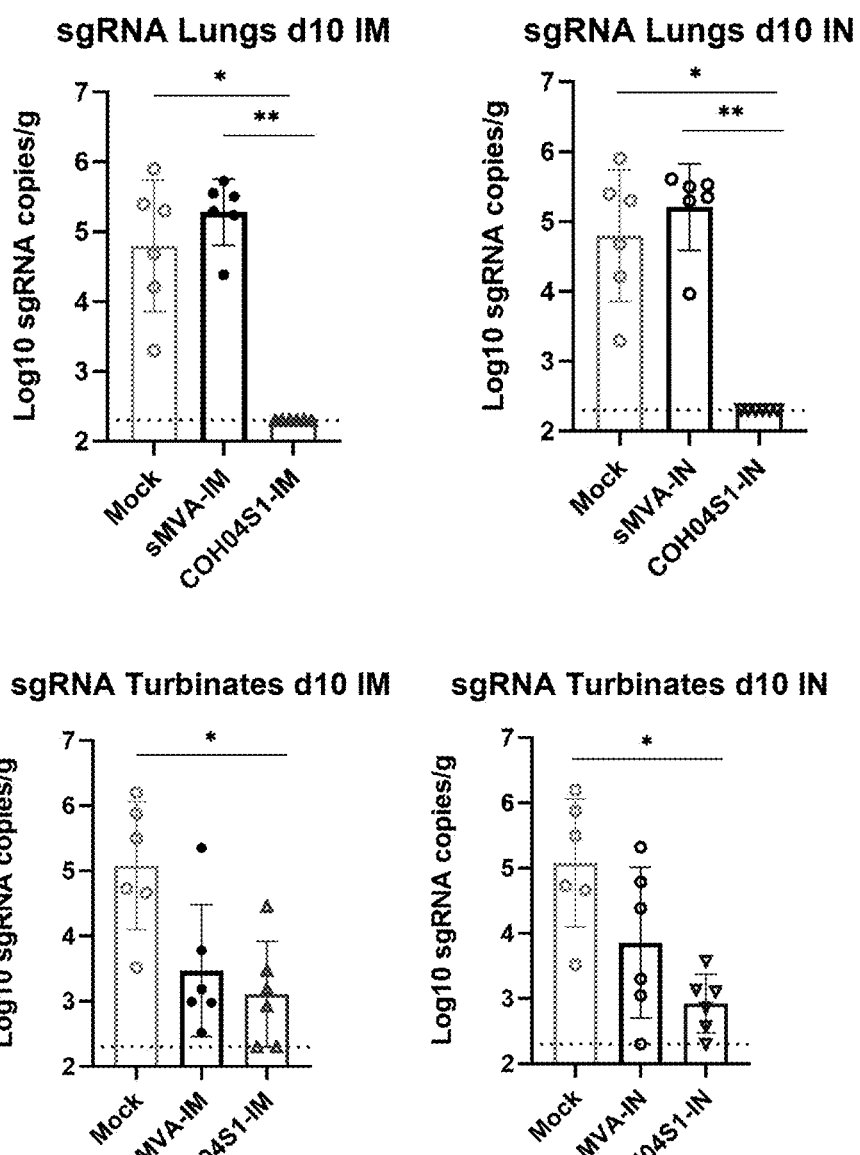

FIGS. 36A-36B show a viral load analysis at day 10 post-challenge. The lungs and turbinates wash were collected 10 days post-challenge and analyzed for the presence of SARS-CoV-2 genomic RNA (gRNA) (FIG. 36A) and sub-genomic RNA (sgRNA, FIG. 36B). Clinical candidate COH04S1 given either intramuscularly (IM) or intranasally (IN) successfully prevented SARS-CoV-2 virus replication in lungs and reduced viral load in nasal turbinates.

FIG. 37 shows strong immune responses induced by intramuscular (IM) and intranasal (IN) vaccinations with clinical candidate COH04S1 in ferrets. Binding antibodies were evaluated using S-, RBD-, and N-IgG ELISA. Titers of neutralizing antibodies were measured using authentic SARS-CoV-2 virus on VeroE6 cells. T cell IFNγ responses in ferret' PBMCs were measured using ferrets IFNγ-ELISPOT.

Figure 38:
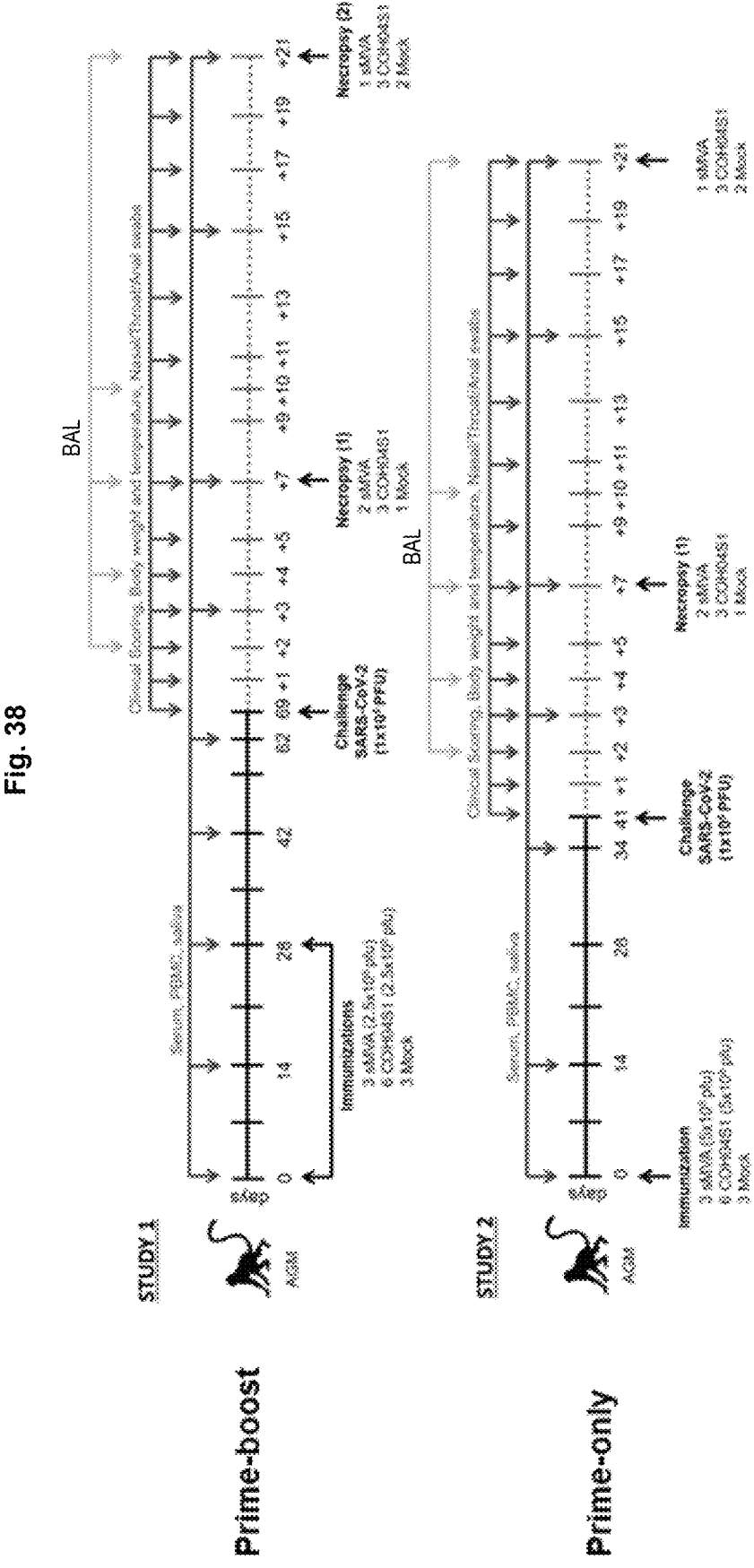

FIG. 38 illustrates the clinical candidate COH04S1 study design in African Green Monkeys (AGMs). The AGMs were immunized once or twice with clinical candidate COH04S1. In the prime-only study (Study 2) animals were immunized with 2.5×10^8 pfu. In the prime-boost study (Study 1) the AGMs were immunized with 1×10^8 pfu.

FIG. 39 shows that the T cell responses were evaluated in clinical candidate COH04S1-immunized AGMs. The levels of IFNγ T cells recognizing Spike(S) and Nucleocapsid (N) were quantified by ELISPOT following stimulation of freshly isolated PBMC with S and N peptide libraries.

FIG. 40 shows Study 1 (prime-boost) cellular responses. The IFNγ, IL-2 and IL-4 responses to Spike(S), Nucleocapsid (N) and Membrane (M) proteins were measured in freshly isolated PBMCs from prime-boosted AGMs 2 weeks and 5 weeks post-boost (time of challenge) by ELISPOT.

FIG. 41 shows Study 2 (prime-only) cellular responses. IFNγ, IL-2 and IL-4 responses to Spike(S), Nucleocapsid (N) and Membrane (M) proteins were measured in freshly isolated PBMC from primed AGM 2 weeks and 5 weeks post-prime (time of challenge) by ELISPOT.

FIG. 42 shows genomic RNA (gRNA) quantification in broncho alveolar lavage (BAL) by qPCR at day 2 and day 4 post-challenge.

FIG. 43 shows viral load quantification in broncho alveolar lavage (BAL) by TCID50 endpoint dilution assay at days 2, 4, and 7 post-challenge for Study 1 and Study 2.

Figure 44:
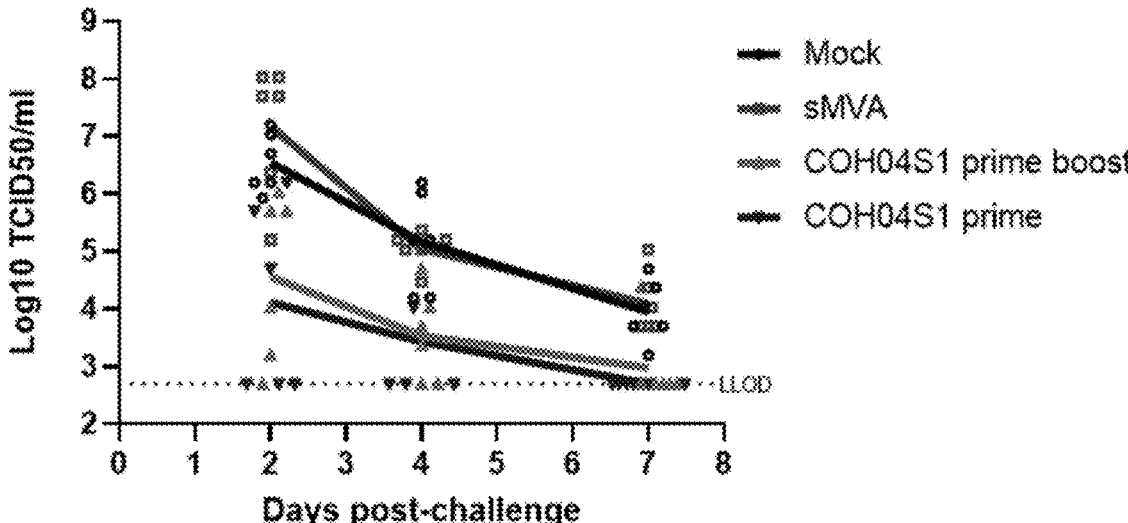

FIG. 44 shows comparison BAL viral loads (TCID50) post-challenge in mock, sMVA and clinical candidate COH04S1 primed and primed-boosted AGMs.

FIG. 45A shows S-, RBD- and N-specific binding antibodies endpoint titers in DL1 sentinels up to day 120. FIG. 45B shows S-, RBD- and N-specific binding antibodies endpoint titers in DL2 sentinels up to day 90. FIG. 45C shows S-, RBD- and N-specific binding antibodies endpoint titers in DL3 sentinels up to day 56.

FIG. 46 shows binding antibodies endpoint titers against S, RBD, and N measured in clinical candidate COH04S1 DL1/DL2/DL3 sentinels up to day 120 post-prime. Serum from 11 individuals who received two doses of the EUA Pfizer-BioNTech SARS-CoV-2 mRNA EUA vaccine based on Spike was analyzed at days 60 and 90 post-vaccine, and antibody titers from a pool of 35 SARS-CoV-2 convalescent individuals who had mild-to-severe SARS-CoV-2 symptoms prior to sample collection were included as a comparison. DL1=4 sentinels d120, DL2-5 sentinels d90, DL3-6 sentinels d56, EUA=14 samples d60, 12 samples d90, convalescents=35 samples.

Figure 47:
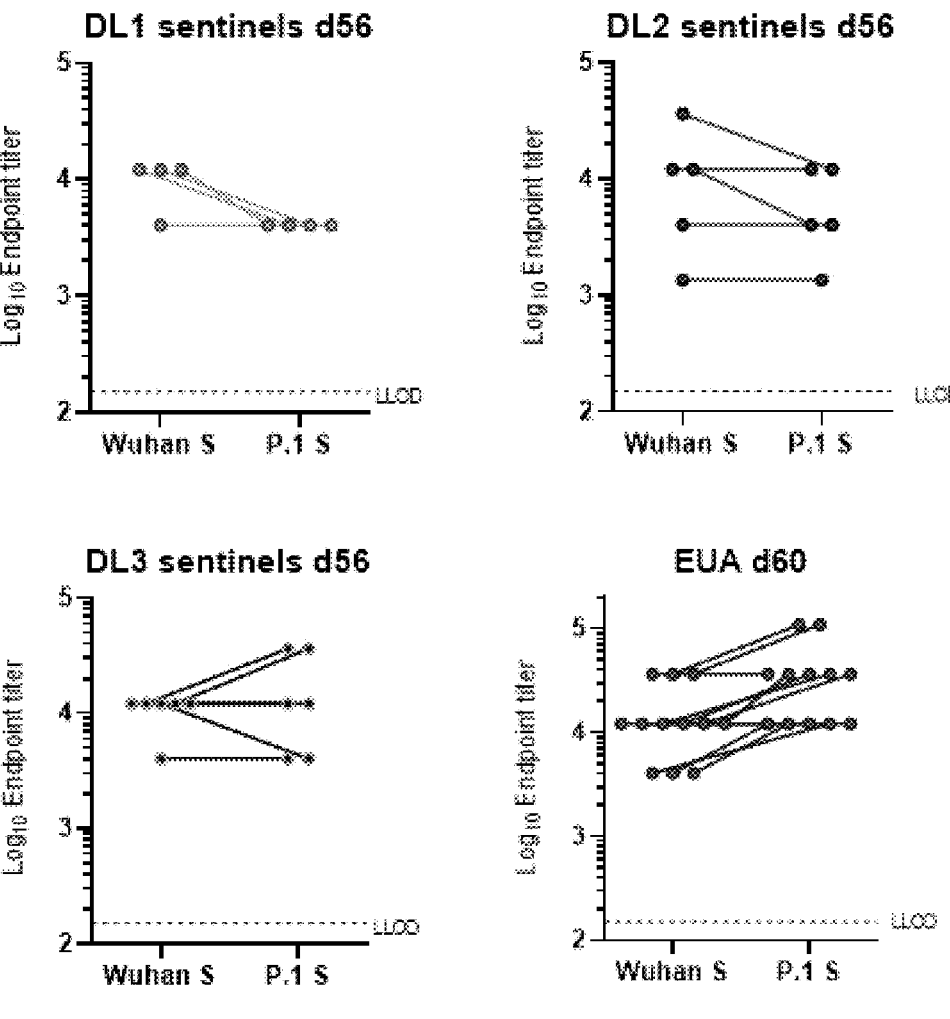

FIG. 47 shows comparison of binding antibodies to Spike (Wuhan D614G strain) and Spike P.1 Brazilian variant of concern (VOC) quantified by ELISA in DL1, DL2 and DL3 sentinels over time (top). Day 56-60 ELISA endpoint titers measured against Wuhan D614G Spike and P.1 Spike in DL1/DL2/DL3 sentinels and EUA Pfizer/BioNTech vaccine recipients (bottom).

FIG. 48 shows neutralizing antibody titers measured using Spike-pseudoviruses from SARS-CoV-2 Wuhan strain with D614G mutation (D614G) and variants of concern (VOC) B.1.1.7 (UK), B.1.351 (RSA) and P.1 (BRA) in DL1, DL2, and DL3 sentinels up to 90 days post-prime immunization.

FIG. 49 shows the neutralizing antibody titers measured using Spike-pseudoviruses from SARS-CoV-2 Wuhan strain with D614G mutation (D614G) and variants of concern (VOC) B.1.1.7 (UK), B.1.351 (RSA) and P.1 (BRA). DL1 and DL2 sentinels were evaluated at day 56, DL3 sentinels at day 42 or 56 when available, and EUA-Pfizer vaccine recipient at day 60.

FIG. 50 shows that healthy adults immunized with clinical candidate COH04S1 (DL1) developed functional T cell responses to S and N antigens in a preliminary analysis.

Figure 51:
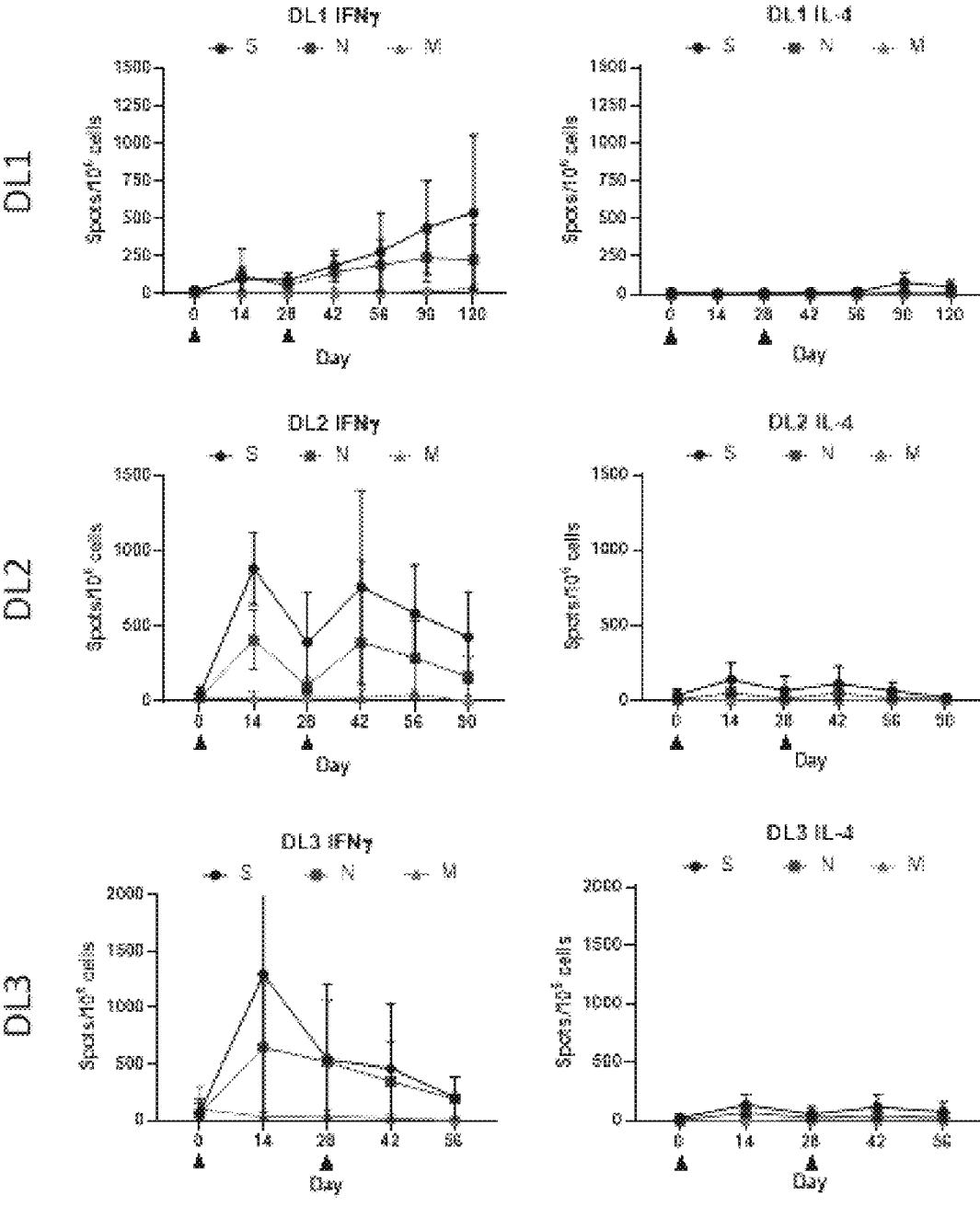

FIG. 51 shows the S-, N- and M-specific IFN-γ and IL-4 T cell responses measured in DL1 sentinels up to day 120, in DL2 sentinels up to day 90, and DL3 sentinels up to day 56 post-prime immunization with clinical candidate COH04S1 using an IFNγ/IL-4 fluorospot. PBMC were cultured in vitro for 48 hours in the presence of Spike, Nucleocapsid or Membrane peptide pools.

FIG. 52 shows that S-, N- and M-specific IFN-γ and IL-4 T cell responses measured in DL1, DL2 and DL3 sentinels up to 120 days post-prime immunization with clinical candidate COH04S1.

Figure 53:
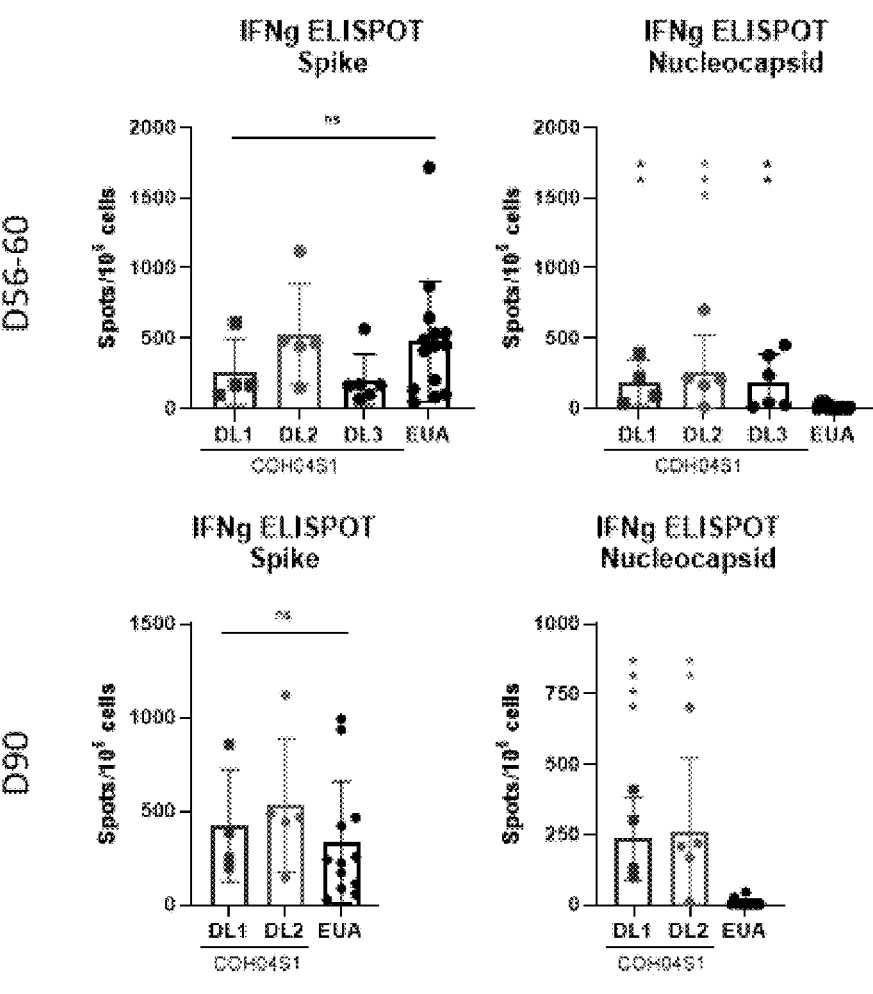
Figure 53:
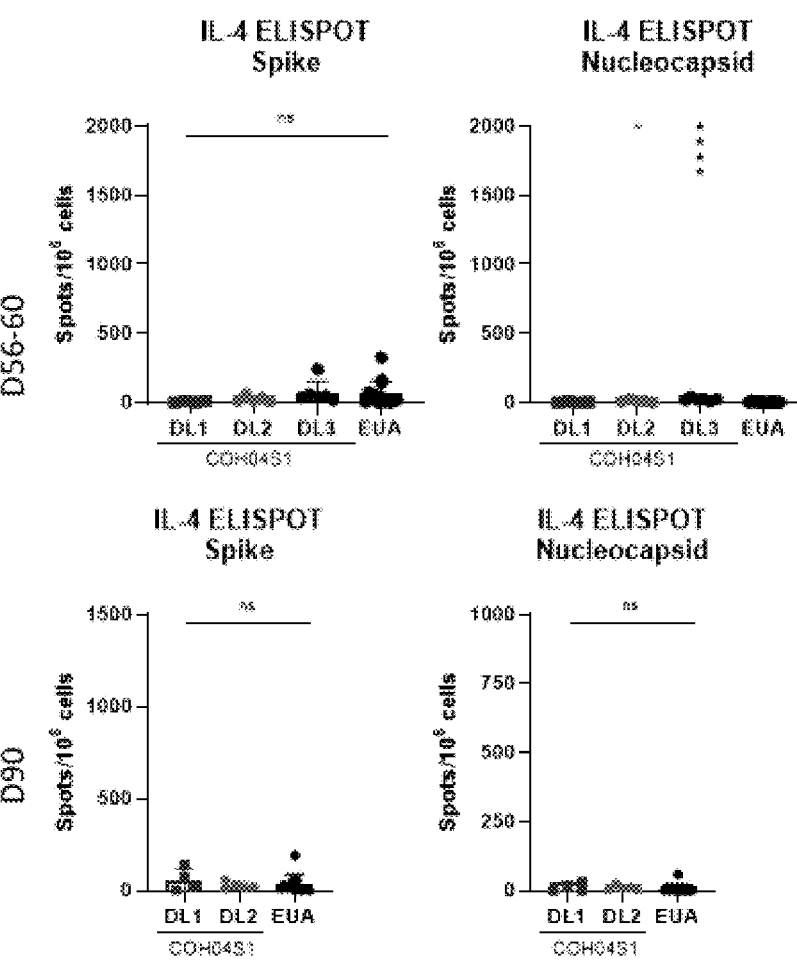

FIG. 53 shows that IFN-γ and IL-4 responses to S and N antigens measured in clinical candidate COH04S1 sentinels and in a pool of Pfizer/BioNTech vaccine recipients at days 56-60 (top) and 90 (bottom) post-prime immunization. COH04S1: d56/d90, EUA: d60/d90, and DO response was subtracted.

FIGS. 54A-54D show antigen expression by SARS-CoV-2 VOC vaccine vectors C163 and C164. CEF cells were infected with the VOC sMVA vectors C163 and C164 or the original COH04S1 sMVA-CoV2 vector (C35) and evaluated by Western Blot using antibodies specific for the S1 and S2 domains of the S protein (αS1 and αS2) or antibodies specific for N (αN). Uninfected CEF cells and CEF cells infected with empty sMVA vector were analyzed for control. Vaccinia B5R protein (αB5R) was detected to verify similar levels of infection between vaccine vectors.

FIGS. 55A-55C show antigen expression by SARS-CoV-2 VOC vaccine vector C170. CEF cells were infected with the VOC sMVA vector C170 or the original CIG04S1 sMVA vaccine construct (C35) and evaluated by Western Blot using antibodies specific for the S1 domain of the S protein (αS1) or antibodies specific for N (αN). Uninfected CEF cells and CEF cells infected with empty sMVA vector were analyzed as a control. Vaccinia B5R protein (αB5R) was detected to verify similar levels of infection between vaccine vectors.

Figure 56:
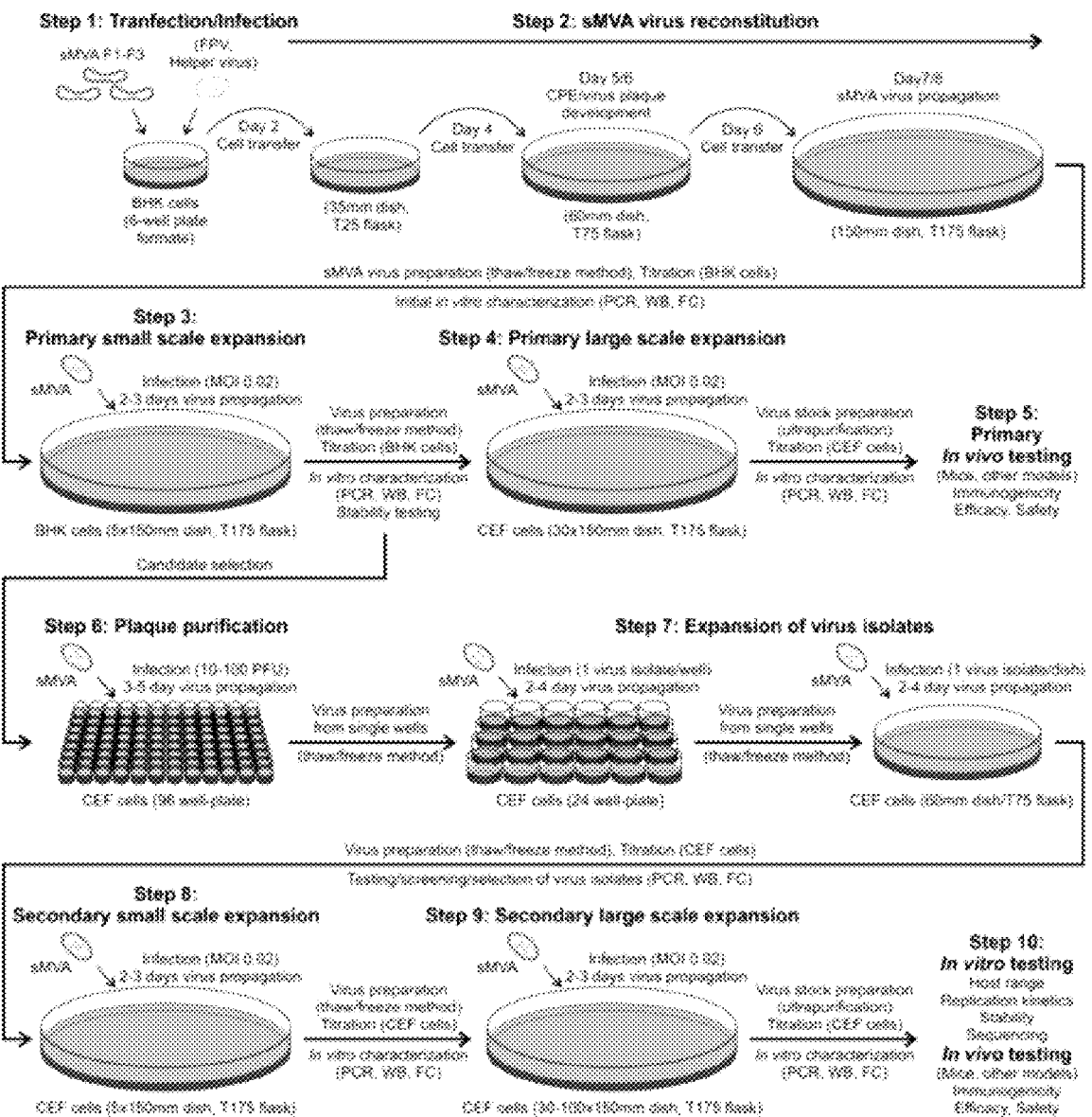

FIG. 56 illustrates an overview of pre-clinical vaccine production process.

Figure 57:
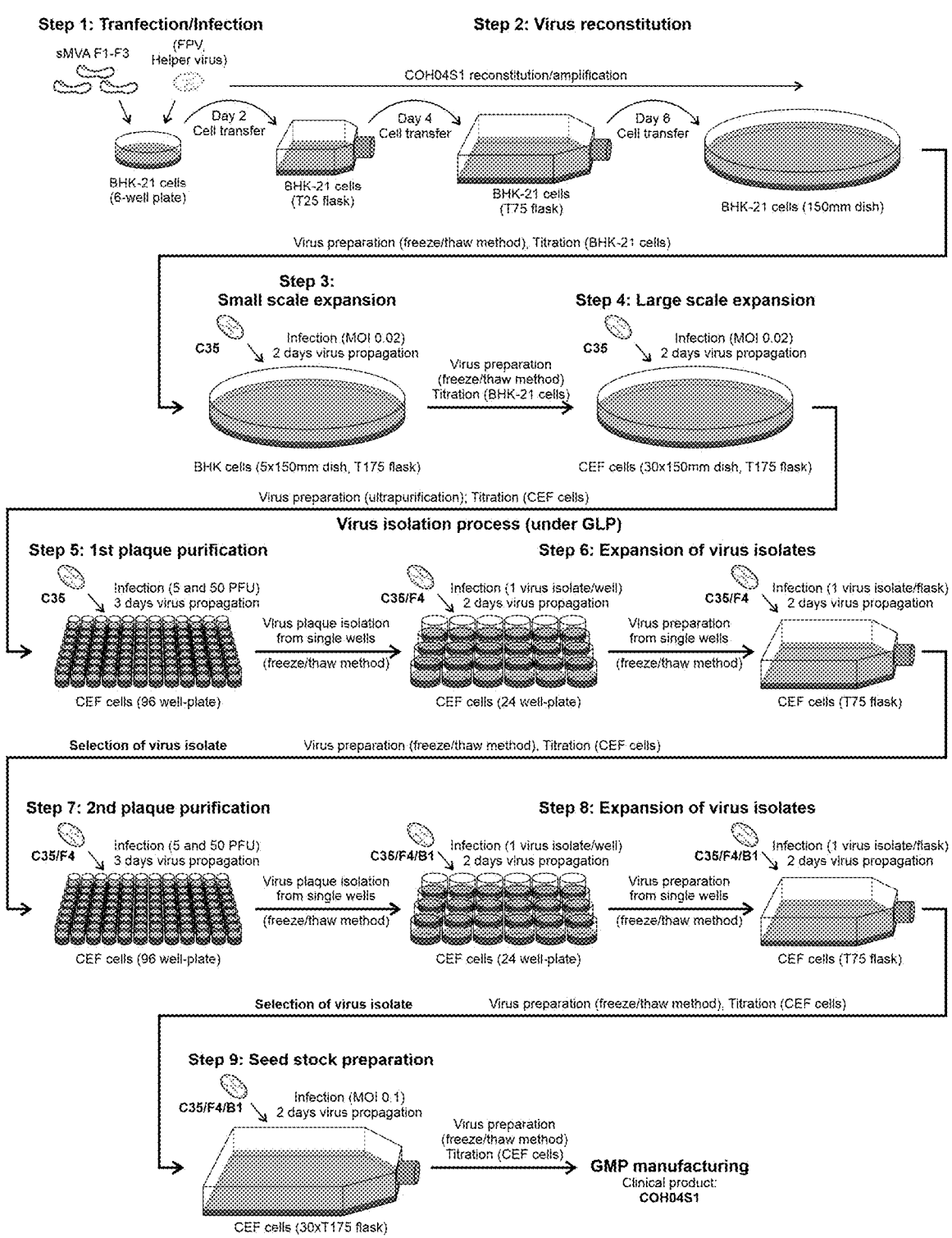

FIG. 57 is an extension of FIG. 56 and illustrates the derivation of clinical vaccine candidate COH04S1 from the original C35 sMVA-N/S vaccine vector.

FIG. 58 shows the sequence of sMVA-N/S (SEQ ID NO: 1) (deposited with NCBI under Accession No. MW036243, ncbi.nlm.nih.gov/nuccore/MW036243.1/).

FIG. 59 shows the sequence of sMVA-S/N (SEQ ID NO: 2) (deposited with NCBI under Accession No. MW030460, ncbi.nlm.nih.gov/nuccore/MW030460.1/).

FIG. 60 shows the DNA sequence/open reading frame (ORF) (5' to 3' end) of the Spike(S) antigen sequence based on the genome sequence of the NCBI SARS-CoV-2 reference strain (#NC_045512) (SEQ ID NO: 3), isolated Wuhan-Hu-1.

FIG. 61 shows the encoded protein sequence (N- to C-terminus) of the Spike(S) antigen sequence based on the genome sequence of the NCBI SARS-CoV-2 reference strain (#NC_045512) (SEQ ID NO: 4), isolated Wuhan-Hu-1.

FIG. 62 shows the DNA sequence/open reading frame (ORF) (5' to 3' end) of the SARS-CoV-2 S antigen sequence based on the Wuhan-Hu-1 reference strain (#NC_045512) (SEQ ID NO: 5) and optimized for stability in vaccinia by silent codon alteration to avoid 4 or more of the same nucleotides in consecutive order.

FIG. 63 shows the encoded protein sequence (N- to C-terminus) of the SARS-CoV-2 S antigen sequence based on the Wuhan-Hu-1 reference strain (#NC_045512) (SEQ ID NO: 6) and optimized for stability in vaccinia by silent codon alteration to avoid 4 or more of the same nucleotides in consecutive order.

FIG. 64 shows the DNA sequence/open reading frame (ORF) (5' to 3' end) of the Nucleocapsid (N) antigen sequence based on the genome sequence of the NCBI SARS-CoV-2 reference strain (#NC_045512) (SEQ ID NO: 7), isolate Wuhan-Hu-1.

FIG. 65 shows the encoded protein sequence (N- to C-terminus) of the Nucleocapsid (N) antigen sequence based on the genome sequence of the NCBI SARS-CoV-2 reference strain (#NC_045512) (SEQ ID NO: 8), isolate Wuhan-Hu-1.

FIG. 66 shows the DNA sequence/open reading frame (ORF) (5' to 3' end) of the SARS-CoV-2 N antigen sequence based on the Wuhan-Hu-1 reference strain (#NC_045512) (SEQ ID NO: 9) and optimized for stability in vaccinia by silent codon alteration to avoid 4 or more of the same nucleotides in consecutive order.

FIG. 67 shows the encoded protein sequence (N- to C-terminus) of the SARS-CoV-2 N antigen sequence based on the Wuhan-Hu-1 reference strain (#NC_045512) (SEQ ID NO: 10) and optimized for stability in vaccinia by silent codon alteration to avoid 4 or more of the same nucleotides in consecutive order.

FIG. 68 shows the DNA sequence/open reading frame (ORF) (5' to 3' end) of the codon-optimized S antigen sequence disclosed above (based on the Wuhan-Hu-1 reference strain (#NC_045512) and optimized for vaccinia) (SEQ ID NO: 11), which is further modified to encode for a prefusion stabilized S antigen with 2P alteration (lysine and valine at amino acid positions 986 and 987 substituted with prolines).

FIG. 69 shows the encoded protein sequence (N- to C-terminus) of the codon-optimized S antigen sequence disclosed above (based on the Wuhan-Hu-1 reference strain (#NC_045512) and optimized for vaccinia) (SEQ ID NO: 12), which is further modified to encode for a prefusion stabilized S antigen with 2P alteration (lysine and valine at amino acid positions 986 and 987 substituted with prolines).

FIG. 70 shows the DNA sequence/ORF (5' to 3' end) of the codon-optimized S antigen sequence disclosed above (based on the Wuhan-Hu-1 reference strain (#NC_045512) and optimized for vaccinia) (SEQ ID NO: 13), which is further modified to encode for a prefusion stabilized S antigen with 2P alteration (lysine and valine at amino acid positions 986 and 987 substituted with prolines) and mutated Furin cleavage site (RRAR amino acids at positions 682-685 substituted with GSAS).

FIG. 71 shows the encoded protein sequence (N- to C-terminus) of the codon-optimized S antigen sequence disclosed above (based on the Wuhan-Hu-1 reference strain (#NC_045512) and optimized for vaccinia) (SEQ ID NO: 14), which is further modified to encode for a prefusion stabilized S antigen with 2P alteration (lysine and valine at amino acid positions 986 and 987 substituted with prolines) and mutated Furin cleavage site (RRAR amino acids at positions 682-685 substituted with GSAS).

FIG. 72 shows the DNA sequence/ORF (5' to 3' end) of the codon-optimized S antigen sequence disclosed above (based on the Wuhan-Hu-1 reference strain (#NC_045512) and optimized for vaccinia) (SEQ ID NO: 15), which is further modified to encode for a prefusion stabilized S antigen with 2P alteration (lysine and valine at amino acid positions 986 and 987 substituted with prolines), mutated Furin cleavage site (RRAR amino acids at positions 682-685 substituted with GSAS), and 19 amino acid residues deleted at the C-terminus to prevent endoplasmic reticulum retention and to enhance cell surface expression.

FIG. 73 shows the encoded protein sequence (N- to C-terminus) of the codon-optimized S antigen sequence disclosed above (based on the Wuhan-Hu-1 reference strain (#NC_045512) and optimized for vaccinia) (SEQ ID NO: 16), which is further modified to encode for a prefusion stabilized S antigen with 2P alteration (lysine and valine at amino acid positions 986 and 987 substituted with prolines), mutated Furin cleavage site (RRAR amino acids at positions 682-685 substituted with GSAS), and 19 amino acid residues deleted at the C-terminus to prevent endoplasmic reticulum retention and to enhance cell surface expression.

FIG. 74 shows a SARS-CoV-2 S antigen sequence (SEQ ID NO: 17) which is fully codon-optimized for human expression, additionally optimized for stability in vaccinia by silent codon alteration to avoid 4 or more of the same nucleotides in consecutive order, and encodes for an S antigen with mutated Furin cleavage site and stabilizing 2P mutation.

FIG. 75 shows a SARS-CoV-2 S antigen sequence (SEQ ID NO: 18) which is fully codon-optimized for vaccinia virus expression, additionally optimized for stability in vaccinia by silent codon alteration to avoid 4 or more of the same nucleotides in consecutive order, and encodes for an S antigen with mutated Furin cleavage site and stabilizing 2P mutation.

FIG. 76 shows a SARS-CoV-2 N antigen sequence (SEQ ID NO: 19) which is fully codon-optimized for human expression and additionally optimized for stability in vaccinia by silent codon alteration to avoid 4 or more of the same nucleotides in consecutive order.

FIG. 77 shows a SARS-CoV-2 N antigen sequence (SEQ ID NO: 20) which is fully codon-optimized for vaccinia virus expression and additionally optimized for stability in vaccinia by silent codon alteration to avoid 4 or more of the same nucleotides in consecutive order.

FIG. 78 shows the DNA sequence/ORF (5' to 3' end) of the S1 domain encompassing 698 amino acid residues of the N-terminus of the SARS-CoV-2 S antigen based on the Wuhan reference strain (#NC_045512) (SEQ ID NO: 21) and optimized for stability in vaccinia.

FIG. 79 shows the encoded protein sequence (N- to C-terminus) of the S1 domain encompassing 698 amino acid residues of the N-terminus of the SARS-CoV-2 S antigen based on the Wuhan reference strain (#NC_045512) (SEQ ID NO: 22) and optimized for stability in vaccinia.

FIG. 80 shows the DNA sequence/ORF (5' to 3' end) of the S1 domain encompassing 680 amino acid residues of the N-terminus of the SARS-CoV-2 S antigen based on the Wuhan reference strain (#NC_045512) (SEQ ID NO: 23) and optimized for stability in vaccinia.

FIG. 81 shows the encoded protein sequence (N- to C-terminus) of the S1 domain encompassing 680 amino acid residues of the N-terminus of the SARS-CoV-2 S antigen based on the Wuhan reference strain (#NC_045512) (SEQ ID NO: 24) and optimized for stability in vaccinia.

FIG. 82 shows the DNA sequence/ORF (5' to 3' end) of an RBD encompassing amino acid residues 331-524 of the SARS-CoV-2 S antigen based on the Wuhan reference strain (#NC_045512) (SEQ ID NO: 25) and optimized for stability in vaccinia fused to the signal peptide of the S antigen (C-terminal 13 amino acids).

FIG. 83 shows the encoded protein sequence (N- to C-terminus) of an RBD encompassing amino acid residues 331-524 of the SARS-CoV-2 S antigen based on the Wuhan reference strain (#NC_045512) (SEQ ID NO: 26) and optimized for stability in vaccinia fused to the signal peptide of the S antigen (C-terminal 13 amino acids).

FIG. 84 shows the DNA sequence/ORF (5' to 3' end) of an RBD encompassing amino acid residues 319-541 of the SARS-CoV-2 S antigen based on the Wuhan reference strain (#NC_045512) (SEQ ID NO: 27) and optimized for stability in vaccinia fused to the signal peptide of the S antigen (C-terminal 13 amino acids).

FIG. 85 shows the encoded protein sequence (N- to C-terminus) of an RBD encompassing amino acid residues 319-541 of the SARS-CoV-2 S antigen based on the Wuhan reference strain (#NC_045512) (SEQ ID NO: 28) and optimized for stability in vaccinia fused to the signal peptide of the S antigen (C-terminal 13 amino acids).

FIG. 86 shows the DNA sequence/ORF (5' to 3' end) of the codon-optimized SARS-CoV-2 S antigen sequence based on the Wuhan-Hu-1 reference strain (#NC_045512) and optimized for vaccinia (SEQ ID NO: 29), which is further modified to encode for an S antigen that includes mutations of the B.1.351 variant lineage identified in South Africa (N501Y, E484K, K417N, L18F, D80A, D215G, Del242-244, R246I, D614G, A701I).

FIG. 87 shows the encoded protein sequence (N- to C-terminus) of the codon-optimized SARS-CoV-2 S antigen sequence based on the Wuhan-Hu-1 reference strain (#NC_045512) (SEQ ID NO: 30) and optimized for vaccinia, which is further modified to encode for an S antigen that includes mutations of the B.1.351 variant lineage identified in South Africa (N501Y, E484K, K417N, L18F, D80A, D215G, Del242-244, R246I, D614G, A701V).

FIG. 88 shows the DNA sequence/ORF (5' to 3' end) of the codon-optimized SARS-CoV-2 S antigen sequence based on the Wuhan-Hu-1 reference strain (#NC_045512) (SEQ ID NO: 31) and optimized for vaccinia, which is further modified to encode for an S antigen that includes mutations of the B.1.1.7 variant lineage identified in the UK (N501Y, Del69/70, Del144, A570D, D614G, P681H, T716I, S982A, D1118H).

FIG. 89 shows the encoded protein sequence (N- to C-terminus) of the codon-optimized SARS-CoV-2 S antigen sequence based on the Wuhan-Hu-1 reference strain (#NC_045512) (SEQ ID NO: 32) and optimized for vaccinia, which is further modified to encode for an S antigen that includes mutations of the B.1.1.7 variant lineage identified in the UK (N501Y, Del69/70, Del144, A570D, D614G, P681H, T716I, S982A, D1118H).

FIG. 90 shows the DNA sequence/ORF (5' to 3' end) of the codon-optimized SARS-CoV-2 S antigen sequence based on the Wuhan-Hu-1 reference strain (#NC_045512) (SEQ ID NO: 33) and optimized for vaccinia, which is further modified to encode for an S antigen that includes mutations of the B.1.429+B.1.427 variant lineage identified in California (D614G, L452R, S13I, W152C).

FIG. 91 shows the encoded protein sequence (N- to C-terminus) of the codon-optimized SARS-CoV-2 S antigen sequence based on the Wuhan-Hu-1 reference strain (#NC_045512) (SEQ ID NO: 34) and optimized for vaccinia, which is further modified to encode for an S antigen that includes mutations of the B.1.429+B.1.427 variant lineage identified in California (D614G, L452R, S13I, W152C).

FIG. 92 shows the DNA sequence/ORF (5' to 3' end) of the codon-optimized SARS-CoV-2 S antigen sequence based on the Wuhan-Hu-1 reference strain (#NC_045512) (SEQ ID NO: 35) and optimized for vaccinia, which is further modified to encode for an S antigen that includes mutations of P.1 variant lineage identified in Brazil (N501Y, E484K, K417T, L18F, T20N, P26S, D138Y, R190S, H655Y, T1027I, V1176F).

FIG. 93 shows the encoded protein sequence (N- to C-terminus) of the codon-optimized SARS-CoV-2 S antigen sequence based on the Wuhan-Hu-1 reference strain (#NC_045512) (SEQ ID NO: 36) and optimized for vaccinia, which is further modified to encode for an S antigen that includes mutations of P.1 variant lineage identified in Brazil (N501Y, E484K, K417T, L18F, T20N, P26S, D138Y, R190S, H655Y, T1027I, V1176F).

FIG. 94 shows the sequence encoding the S antigen of the Wuhan-Hu-1 reference strain (SEQ ID NO: 37).

FIG. 95 shows the sequence encoding the S antigen of the South African variant B.1.351 (SEQ ID NO: 38).

FIG. 96 shows the sequence encoding the S antigen of the UK variant B.1.1.7 (SEQ ID NO: 39).

FIG. 97 shows the DNA sequence/ORF (5' to 3' end) (SEQ ID NO: 40) of the RBD domain of the Wuhan-Hu-1 reference strain, the RBD domain of the B.1.351 variant, and an RBD domain combining N501Y and L452R mutations of the B.1.1.7 and B.1.429+B.1.427 variants co-expressed by a triple polycistronic expression construct which comprises at the N-terminus a signal peptide of the S antigen (MFVFLVLLPLVSSQCV, SEQ ID NO: 41) and in which the RBD domains are connected through GS linkers such as GSGSGS (SEQ ID NO: 42).

FIG. 98 shows the encoded protein sequence (N- to C-terminus) (SEQ ID NO: 43) of the RBD domain of the Wuhan-Hu-1 reference strain, the RBD domain of the B.1.351 variant, and an RBD domain combining N501Y and L452R mutations of the B.1.1.7 and B.1.429+B.1.427 variants co-expressed by a triple polycistronic expression construct which comprises at the N-terminus a signal peptide of the S antigen (MFVFLVLLPLVSSQCV, SEQ ID NO: 41) and in which the RBD domains are connected through GS linkers such as GSGSGS (SEQ ID NO: 42).

FIG. 99 shows the DNA sequence/ORF (5' to 3' end) (SEQ ID NO: 44) of the RBD domain of the Wuhan-Hu-1 reference strain, the RBD domain of the B.1.351 variant, and a RBD domain combining the N501Y and L452R mutations of the B.1.1.7 and B.1.429+B.1.427 variants co-expressed by a triple polycistronic expression construct comprising at the N-terminus a signal peptide of the S antigen (MFVFLVLLPLVSSQCV, SEQ ID NO: 41) and at the C-terminus a T4 Foldon domain (GYIPEAPRDGQAY-VRKDGEWVLLSTFL, SEQ ID NO: 45) and in which the RBD domains are connected through GS linkers such as GSGSGS (SEQ ID NO: 42).

FIG. 100 shows the encoded protein sequence (N- to C-terminus) (SEQ ID NO: 46) of the RBD domain of the Wuhan-Hu-1 reference strain, the RBD domain of the B.1.351 variant, and a RBD domain combining the N501Y and L452R mutations of the B.1.1.7 and B.1.429+B.1.427 variants co-expressed by a triple polycistronic expression construct comprising at the N-terminus a signal peptide of the S antigen (MFVFLVLLPLVSSQCV, SEQ ID NO: 41) and at the C-terminus a T4 Foldon domain (GYIPEAPRDGQAYVRKDGEWVLLSTFL, SEQ ID NO: 45) and in which the RBD domains are connected through GS linkers such as GSGSGS (SEQ ID NO: 42).

FIG. 101 shows the DNA sequence/ORF (5' to 3' end) (SEQ ID NO: 47) of the RBD domain of the Wuhan-Hu-1 reference strain, the RBD domain of the B.1.351 variant, and an RBD domain combining N501Y and L452R mutations of the B.1.1.7 and B.1.429+B.1.427 variants co-expressed by a polycistronic expression construct in which each RBD domain comprises at the N-terminus a signal peptide of the S antigen (MFVFLVLLPLVSSQCV, SEQ ID NO: 41) and in which the RBD domains are connected through GS linkers such as GSGSGS (SEQ ID NO: 42) and P2A and T2A peptides.

FIG. 102 shows the encoded protein sequence (N- to C-terminus) (SEQ ID NO: 48) of the RBD domain of the Wuhan-Hu-1 reference strain, the RBD domain of the B.1.351 variant, and an RBD domain combining N501Y and L452R mutations of the B.1.1.7 and B.1.429+B.1.427 variants co-expressed by a polycistronic expression construct in which each RBD domain comprises at the N-terminus a signal peptide of the S antigen (MFVFLVLLPLVSSQCV, SEQ ID NO: 41) and in which the RBD domains are connected through GS linkers such as GSGSGS (SEQ ID NO: 42) and P2A and T2A peptides.

FIG. 103 shows the DNA sequence/ORF (5' to 3' end) (SEQ ID NO: 49) of the RBD domain of the Wuhan-Hu-1 reference strain, the RBD domain of the B.1.351 variant, and a RBD domain combining N501Y and L452R mutations of the B.1.1.7 and B.1.429+B.1.427 variants co-expressed by a polycistronic expression construct in which the RBD domains are connected through GS linkers (GSGSGS, SEQ ID NO: 42) and P2A and T2A peptides and in which each RBD domain is fused at the N-terminus to a S signal peptide (MFVFLVLLPLVSSQCV, SEQ ID NO: 41) and at the C-terminus to a T4 Foldon domain (GYIPEAPRDGQAY-VRKDGEWVLLSTFL, SEQ ID NO: 45).

FIG. 104 shows the encoded protein sequence (N- to C-terminus) (SEQ ID NO: 50) of the RBD domain of the Wuhan-Hu-1 reference strain, the RBD domain of the B.1.351 variant, and a RBD domain combining N501Y and L452R mutations of the B.1.1.7 and B.1.429+B.1.427 variants co-expressed by a polycistronic expression construct in which the RBD domains are connected through GS linkers (GSGSGS, SEQ ID NO: 42) and P2A and T2A peptides and in which each RBD domain is fused at the N-terminus to a S signal peptide (MFVFLVLLPLVSSQCV, SEQ ID NO: 41) and at the C-terminus to a T4 Foldon domain (GYIPEAPRDGQAYVRKDGEWVLLSTFL, SEQ ID NO: 45).

FIG. 105 shows the DNA sequence/ORF (5' to 3' end) (SEQ ID NO: 51) of the RBD domain of the Wuhan-Hu-1 reference strain, the RBD domain of the B.1.351 variant, and an RBD domain combining N501Y and L452R mutations of the B.1.1.7 and B.1.429+B.1.427 variants co-expressed by a polycistronic expression construct comprising at the N-terminus a signal peptide of the S antigen (MFVFLVLLPLVSSQCV, SEQ ID NO: 41) and at the C-terminus TM and CT domains (without the last 19 amino acids) of the S antigen and in which the RBD domains are connected through GS linkers such as GSGSGS (SEQ ID NO: 42).

FIG. 106 shows the encoded protein sequence (N- to C-terminus) (SEQ ID NO: 52) of the RBD domain of the Wuhan-Hu-1 reference strain, the RBD domain of the B.1.351 variant, and an RBD domain combining N501Y and L452R mutations of the B.1.1.7 and B.1.429+B.1.427 variants co-expressed by a polycistronic expression construct comprising at the N-terminus a signal peptide of the S antigen (MFVFLVLLPLVSSQCV, SEQ ID NO: 41) and at the C-terminus TM and CT domains (without the last 19 amino acids) of the S antigen and in which the RBD domains are connected through GS linkers such as GSGSGS (SEQ ID NO: 42).

FIG. 107 shows the DNA sequence/ORF (5' to 3' end) (SEQ ID NO: 53) of the RBD domain of the Wuhan-Hu-1 reference strain, the RBD domain of the B.1.351 variant, and an RBD domain combining N501Y and L452R mutations of the B.1.1.7 and B.1.429+B.1.427 variants co-expressed by a polycistronic expression construct in which each of the RBD domains comprises at the N-terminus a signal peptide of the S protein (MFVFLVLLPLVSSQCV, SEQ ID NO: 41) and at the C-terminus TM and CT domains (without the last 19 amino acids) of the S antigen and in which the RBD domains are connected through GS linkers such as GSGSGS (SEQ ID NO: 42) and P2A and T2A peptide sequences.

FIG. 108 shows the encoded protein sequence (N- to C-terminus) (SEQ ID NO: 54) of the RBD domain of the Wuhan-Hu-1 reference strain, the RBD domain of the B.1.351 variant, and an RBD domain combining N501Y and L452R mutations of the B.1.1.7 and B.1.429+B.1.427 variants co-expressed by a polycistronic expression construct in which each of the RBD domains comprises at the N-terminus a signal peptide of the S protein (MFVFLVLLPLVSSQCV, SEQ ID NO: 41) and at the C-terminus TM and CT domains (without the last 19 amino acids) of the S antigen and in which the RBD domains are connected through GS linkers such as GSGSGS (SEQ ID NO: 42) and P2A and T2A peptide sequences.

FIG. 109 shows the DNA sequence/ORF (5' to 3' end) of a codon-optimized N antigen that includes the N-specific mutations in the B.1.1.7 variant lineage identified in the UK (SEQ ID NO: 55), including an aspartic acid to leucine substitution at amino acid position 3 of the N protein (D3L), a serine to phenylalanine substitution at amino acid position 235 of the N protein (S235F), an arginine to lysine substitution at amino acid position 203 of the N protein (R203K), and a glycine to arginine substitution at amino acid position 204 of the N protein (G204R).

FIG. 110 shows the encoded protein sequence (N- to C-terminus) of a codon-optimized N antigen that includes the N-specific mutations in the B.1.1.7 variant lineage identified in the UK (SEQ ID NO: 56), including an aspartic acid to leucine substitution at amino acid position 3 of the N protein (D3L), a serine to phenylalanine substitution at amino acid position 235 of the N protein (S235F), an arginine to lysine substitution at amino acid position 203 of the N protein (R203K), and a glycine to arginine substitution at amino acid position 204 of the N protein (G204R).

FIG. 111 shows the DNA sequence/ORF (5' to 3' end) of a codon-optimized N antigen that includes the N-specific mutations in the B.1.351 variant lineage identified in South Africa (SEQ ID NO: 57), including a threonine to isoleucine substitution at amino acid position 205 of the N protein (T205I).

FIG. 112 shows the encoded protein sequence (N- to C-terminus) of a codon-optimized N antigen that includes the N-specific mutations in the B.1.351 variant lineage identified in South Africa (SEQ ID NO: 58), including a threonine to isoleucine substitution at amino acid position 205 of the N protein (T205I).

FIG. 113 shows the DNA sequence/ORF (5' to 3' end) of a codon-optimized N antigen that includes the N-specific mutations in the P.1 variant lineage identified in Brazil (SEQ ID NO: 59), including a proline to arginine substitution at amino acid position 80 of the N protein (P80R), as well as R203K and G204R.

FIG. 114 shows the encoded protein sequence (N- to C-terminus) of a codon-optimized N antigen that includes the N-specific mutations in the P.1 variant lineage identified in Brazil (SEQ ID NO: 60), including a proline to arginine substitution at amino acid position 80 of the N protein (P80R), as well as R203K and G204R.

FIG. 115 shows the DNA sequence/ORF (5' to 3' end) of the codon-optimized SARS-CoV-2 S antigen sequence based on the Wuhan-Hu-1 reference strain (#NC_045512) (SEQ ID NO: 61) and optimized for vaccinia, which is further modified to encode for an S antigen that includes mutations of the B.1.617 variant lineage identified in India, including L452R and E484Q mutations in the RBD domain, D614G, a glycine to aspartic acid substitution at amino acid position 142 of the S protein (G142D), a glutamic acid to lysine substitution at amino acid position 154 of the S protein (E154K), a proline to lysine substitution at amino acid position 681 of the S protein (P681R), a glutamine to histidine substitution at amino acid position 1071 of the S protein (Q1071H), and a histidine aspartic acid substitution at amino acid position 1101 of the S protein (H1101D).

FIG. 116 shows the encoded protein sequence (N- to C-terminus) of the codon-optimized SARS-CoV-2 S antigen sequence (SEQ ID NO: 62) based on the Wuhan-Hu-1 reference strain (#NC_045512) and optimized for vaccinia, which is further modified to encode for an S antigen that includes mutations of the B.1.617 variant lineage identified in India, including L452R and E484Q mutations in the RBD domain, D614G, a glycine to aspartic acid substitution at amino acid position 142 of the S protein (G142D), a glutamic acid to lysine substitution at amino acid position 154 of the S protein (E154K), a proline to lysine substitution at amino acid position 681 of the S protein (P681R), a glutamine to histidine substitution at amino acid position 1071 of the S protein (Q1071H), and a histidine aspartic acid substitution at amino acid position 1101 of the S protein (H1101D).

FIG. 117 shows the DNA sequence/ORF (5' to 3' end) of the codon-optimized SARS-CoV-2 N antigen sequence encoding for an N antigen that includes the N-specific mutations in the B.1.617 variant lineage identified in India (SEQ ID NO: 63), including an arginine to methionine substitution at amino acid position 203 of the N protein (R203M) and an aspartic acid to tyrosine substitution at amino acid position 377 of the N protein (D377Y).

FIG. 118 shows the encoded protein sequence (N- to C-terminus) of the codon-optimized SARS-CoV-2 N antigen sequence encoding for an N antigen that includes the N-specific mutations in the B.1.617 variant lineage identified in India (SEQ ID NO: 64), including an arginine to methionine substitution at amino acid position 203 of the N protein (R203M) and an aspartic acid to tyrosine substitution at amino acid position 377 of the N protein (D377Y).

DETAILED DESCRIPTION

Disclosed herein are methods of producing recombinant sMVA (rsMVA) expressing one or more heterologous gene sequences encoding coronavirus antigens. A fully synthetic version of MVA (sMVA) from circularized or linear synthetic DNA fragments is produced and disclosed in PCT application No. PCT/US21/16247, the content of which is incorporated by reference in its entirety. The sMVA or the rsMVA can be used as a vaccine for preventing and treating various conditions such as coronavirus infections and associated diseases.

Since the outbreak of the novel severe acute respiratory syndrome coronavirus-2 (SARS-CoV-2) in December 2019, the virus has spread to more than 200 countries worldwide, causing a pandemic of global magnitude with over 3 million deaths. Many vaccine candidates are currently under rapid development to control this global pandemic, some of which have entered with unprecedented pace into clinical trials. Most of these approaches employ antigenic forms of the Spike (S) protein as it is considered the primary target of protective immunity[16,20-22]. The S protein mediates SARS-CoV-2 entry into a host cell through binding to angiotensin-converting enzyme 2 (ACE) and is the major target of neutralizing antibodies (NAb)[23-25]. Studies in rhesus macaques show that vaccine strategies based on the S antigen can prevent SARS-CoV-2 infection and disease in this relevant animal model[18], indicating that the S antigen may be sufficient as vaccine immunogen to elicit protective immunity. However, a recent study showed that even patients without measurable NAb can recover from SARS-CoV-2 infection, suggesting that protection against SARS-CoV-2 infection is mediated by both humoral and cellular immunity to multiple immunodominant antigens, including S and Nucleocapsid (N) antigens[20,26]. In this disclosure, the terms of "S protein" and "S antigen" are used interchangeably, and the terms of "N protein" and "N antigen" are used interchangeably.

Disclosed herein is a novel vaccine platform based on a uniquely designed three-plasmid system to efficiently generate recombinant MVA vectors from chemically synthesized DNA. In response to the ongoing global SARS-CoV-2 pandemic, this novel vaccine platform can be used to rapidly produce sMVA vectors co-expressing SARS-CoV-2 S and N antigens or any additional antigens. These antigens used for vaccine production can be based on the Wuhan reference strain or include one or more mutations based on emerging VOCs. As demonstrated in the working examples, these sMVA vectors induced potent SARS-CoV-2 antigen-specific humoral and cellular immunity in mice, including potent NAb. These results highlight the feasibility to efficiently produce recombinant MVA vectors from chemically synthesized DNA and to rapidly develop a synthetic poxvirus-based vaccine candidate to prevent SARS-CoV-2 infection.

Disclosed herein is a synthetic form of MVA and a method of producing the same using chemically synthesized DNA, which differs from the recently described approach to produce a synthetic horsepox virus vaccine vector[42]. In certain embodiments, a single DNA fragment is derived from viral DNA or chemically synthesized and comprises the entire genome sequence of MVA. This single DNA fragment can be used to transfect a host cell such that the MVA is reconstituted. In other embodiments, two or more naturally derived or chemically synthesized DNA fragments, or a combination thereof, are used to co-transfect a host cell, wherein each DNA fragment comprises a partial sequence of the MVA genomic DNA with overlapping sequences at the ends of two adjacent DNA fragments, such that when the two or more DNA fragments are co-transfected into the host cell, they assemble with each other by homologous recombination to form MVA comprising a full-length sequence of the desired MVA genome. In certain embodiments, the overlapping sequence is between about 100 bp and about 5000 bp in length.

In certain embodiments, one or more naturally derived or chemically synthesized DNA fragment(s) comprising the MVA genome or subgenomic DNA may be further modified to form artificial hybrid fragments composed of natural and synthetic MVA genomic DNA sequences.

In certain embodiments, the host cell is infected with a helper virus such as FPV before, during, or after the transfection of one or more DNA fragments comprising the sequence of the MVA genome or subgenomic DNA.

Figure 1D:
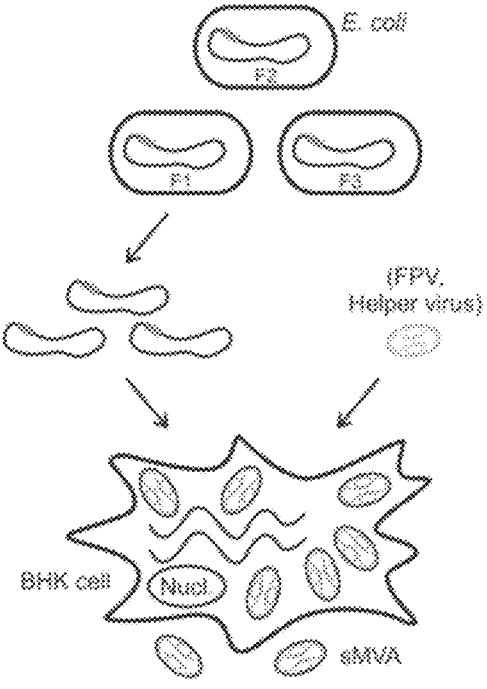
Figure 1E:
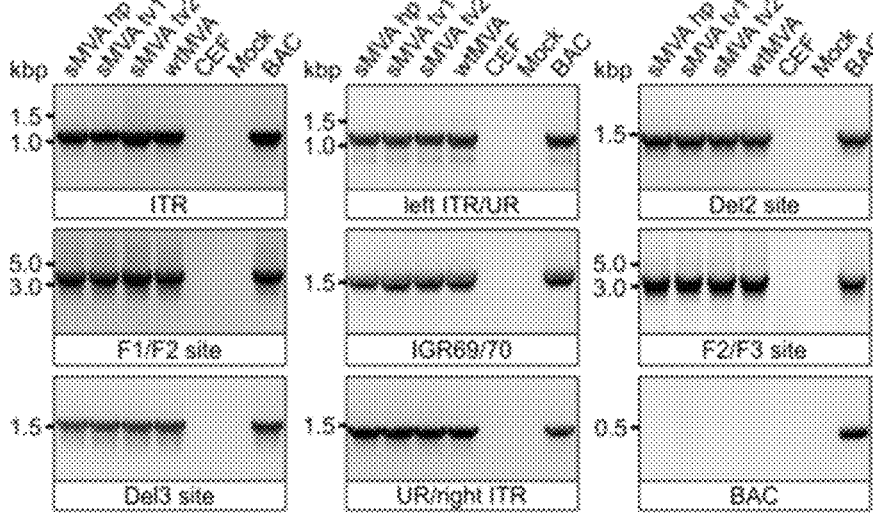

As demonstrated herein, the disclosed technique of generating sMVA involves the use of three large circular DNA fragments (about 60 kbp) with intrinsic HL and CR sequences (FIG. 1), the approach by Noyce et al. to produce a synthetic horsepox vaccine involves the use of multiple smaller linear DNA fragments (about 10-30 kbp) and the addition of terminal HL sequences[42]. Because the three sMVA fragments are used in a circular form for the sMVA reconstitution process they are easily maintained in *E. coli* as BACs and transferred to BHK-21 cells for sMVA virus reconstitution without the need for additional purification steps or modifications. This feature greatly facilitates the insertion of heterologous antigen sequences into the sMVA DNA by highly efficient bacterial recombination techniques and to produce recombinant sMVA vaccine vectors. Additionally, the three plasmid system provides the flexibility for rapid production of recombinant MVA harboring multiple antigens inserted into different MVA insertion sites, which can be particularly laborious when generating recombinant MVA by the conventional transfection/infection procedure[3,43]. The three sMVA fragments efficiently recombine with one another and produce a synthetic form of MVA that is virtually identical to wtMVA in genome content, replication properties, host cell range, and immunogenicity.

More specifically, as illustrated in FIG. 1A, the MVA genome comprises an internal unique region (UR) flanked by ~9.6 kbp long inverted terminal repeat (ITR) regions. The MVA genome sequence published by Antoine and colleagues (Accession #U94848), herein referred to as MVA strain Antoine, differs in five base pairs in the internal UR from the MVA genome of the licensed and commercially available National Institute of Health clone 1 from 1974 (MVA NIH clone 1), which is identical in sequence to the published genome of MVA strain Acambis (Accession #AY603355). sMVA fragment 1 (F1) encompasses the left ITR and ~50 kbp of the left end of internal UR of the MVA genome; sMVA fragment 2 (F2) contains ~60 kbp of the middle part of the internal UR of the MVA genome; and sMVA fragment 3 (F3) encompasses ~50 kbp of the right end of the internal UR and the right ITR of the MVA genome (FIG. 1B). sMVA F1 and F2 as well as sMVA F2 and F3 are designed to share ~3 kbp overlapping sequences to allow the reconstitution of the complete MVA genome by homologous recombination (FIG. 1B). A duplex copy of the 165-nucleotide long MVA terminal hairpin loop (HL) flanked by MVA concatemeric resolution sequences is added to both ends of each of the three fragments to promote MVA genome resolution and packaging (FIG. 1C). The three sMVA fragments are cloned and maintained in *E. coli* (DH10B, EPI300, GS1783) by a yeast-bacterial shuttle vector, termed pCCI-Brick (GeneScript), which contains a bacterial mini-F replicon element that can be used as a BAC vector to stably propagate the three fragments at low copy number in bacteria (FIG. 1). Next generation sequencing analysis confirmed the integrity of the MVA genomic sequences of the fragments, with the notable exception of an unknown single point mutation within sMVA fragment F1 that is located in a non-coding determining region at 3 bp downstream of 021L.

When baby hamster kidney (BHK) are co-transfected with the three plasmids containing the sMVA fragments F1-F3 (FIG. 1) and subsequently infected with Fowlpox virus (FPV) as a helper virus, the three sMVA fragments recombine with each other through the shared homologous sequences and the reconstitution of synthetic MVA (sMVA) is initiated (FIG. 3D). FPV is used as a helper virus to initiate the transcription of the sMVA DNA and, consequently, the sMVA reconstitution process. In the absence of a helper virus, the "naked" sMVA DNA may not promote virus reconstitution as poxvirus DNA is considered as non-infectious. Importantly, while BHK-21 cells are highly permissive for MVA infection and replication, they are not permissive for productive FPV infection, leading to immediate removal of the FPV helper virus following sMVA virus reconstitution in BHK-21 cells. In addition, FPV used as a helper virus in mammalian cells promotes highly efficient and selective packaging of vaccinia virus genomes.

Also disclosed is a multi-antigenic sMVA-CoV2 vaccine using the highly versatile synthetic vaccine platform based on sMVA. MVA is a highly attenuated poxvirus vector, widely used to develop vaccines for infectious diseases and cancer. There is a long history of safety, efficacy and long-term protection in humans. New Spike variants of SARS-CoV-2 can be quickly cloned into one of three plasmids that when recombined form an sMVA vaccine.

As disclosed herein, the multiple antigens, subunits thereof, or fragments thereof can be co-expressed using the same promoter or different promoters, optionally linked by 2A peptides. The sequences encoding the multiple antigens, subunits thereof, or fragments thereof can be inserted at the same insertion site or different insertion sites of sMVA. For example, the vaccine composition comprising two or more antigens encoding for at least two S or N proteins, S1 or S2 domains, or RBDs are co-expressed using the same promotor or separate promoters or the same insertion site or separate insertion sites. In another example, the vaccine composition comprising two or more antigens encoding for at least two S or N proteins, S1 or S2 domains, or RBD are linked by 2A peptides and co-expressed through polycistronic constructs by the same promoter.

In certain embodiments, the vaccine composition disclosed herein comprises a mixture of two or more sMVA vectors which encode two or more different SARS-CoV-2 antigen sequences selected from the Wuhan-Hu-1 reference strain and different VOC. For example, one sMVA vector in the mixture comprises sequences encoding SARS-CoV-2 antigens from the Wuhan-Hu-1 reference strain, and another sMVA vector in the mixture comprises sequences encoding SARS-CoV-2 antigens from a VOC.

MVA is a highly attenuated strain of vaccinia. Mammalian cells are permissive to MVA, including human cells, propagation restricted to avian cells. MVA also has multi-antigenic capacity (30 Kb) and can be easily modified to assemble new vaccines against viral variants, e.g. UK or RSA variants. MVA is an attenuated viral vaccine, which has advantage in immunogenicity, compared to DNA/RNA/protein vaccines. MVA is capable of long-lived high titer humoral and high frequency cellular immune responses, maintains immunogenicity as lyophilizate to eliminate cold chain resulting in cheaper storage and transport. Safety and efficacy of MVA-based vaccines were established in human trials since the 1970s. Over 150,000 people were successfully immunized in historical studies, including children and the elderly. Multiple studies sponsored by NIAID showed safety after immunization in HIV-infected adults. MVA is suitable for providing lifelong immunity against smallpox based on FDA approval as Jynneos™ (Bavarian-Nordic). Multiple MVA-based vaccines have been developed and successfully investigated at COH. Healthy volunteers and transplant patients develop strong immunity even after a single dose.

In contrast to most other currently employed SARS-CoV-2 vaccine approaches that solely rely on the S antigen, the disclosed SARS-CoV-2 vaccine approach using sMVA employs immune stimulation by S and N antigens, both are implicated in protective immunity[20,26]. The observation that the sMVA-CoV2 vectors co-expressing S and N antigens can stimulate potent NAb against SARS-CoV-2 pseudovirus and infectious authentic SARS-CoV2 virions suggests that they can elicit antibodies that are considered effective in preventing SARS-CoV-2 infection and COVID-19 disease[16,18,20,21]. The working examples demonstrate that the vaccine vectors stimulated a Th1-biased antibody and cellular immune response, which is considered the preferred antiviral adaptive immune response to avoid vaccine associated enhanced respiratory disease[44,45]. Moreover, no evidence is found for Fc-mediated ADE promoted by the vaccine-induced immune sera, suggesting that antibody responses induced by the vaccine vectors bear minimal risk for ADE-mediated immunopathology, a general concern in SARS-CoV-2 vaccine development[44,45]. Other immune responses besides NAb targeting the S antigen may contribute to the protection against SARS-CoV-2 infection, which is highlighted by the finding that even patients without measurable NAb can recover from SARS-CoV-2 infection[20]. While antibodies could be particular important to prevent initial SARS-CoV-2 acquisition, T cell responses may impose an additional countermeasure to control sporadic virus spread at local sites of viral infection, thereby limiting virus transmission. The disclosed dual recombinant vaccine approach based on sMVA to induce robust humoral and cellular immune responses to S and N antigens may provide protection against SARS-CoV-2 infection beyond other vaccine approaches using solely the S antigen.

sMVA recombinants are produced by inserting the sequences encoding one or more antigens or subunits thereof into one or more MVA fragments. In certain embodiments, the DNA sequences of the antigens, subunits, or fragments thereof are codon optimized for expression in the host cell. In certain embodiments, the one or more antigens include human coronavirus antigens such as the S protein, N protein, M protein, E protein, papain-like protease, ORF1A, 3CL protease, ORF1B, endoribonuclease, matrix, helicase, or immunogenic fragments thereof. In certain embodiments, the one or more antigens include a subunit of S protein such as S1 and S2 domains, or the receptor-binding domain (RBD) of the S antigen. In certain embodiments, the one or more antigens include a prefusion form of the S antigen and a mutated S antigen. For example, the SARS-CoV-2 S antigen can be further stabilized by including a mutated Furin cleavage site such that amino acid residues 682-685 RRAR are mutated to GSAS. In another example, lysine 986 and valine 987 of the S antigen are substituted with prolines. In certain embodiments, the S antigen and the N antigen are fully mature or fully glycosylated.

In certain embodiments, the sequence of sMVA-N/S (deposited with NCBI under Accession No. MW036243, ncbi.nlm.nih.gov/nuccore/MW036243.1/) is shown in FIG. 58.

In certain embodiments, the sequence of sMVA-S/N (deposited with NCBI under Accession No. MW030460, ncbi.nlm.nih.gov/nuccore/MW030460.1/) is shown in FIG. 59.

As disclosed herein, sequences of various SARS-CoV-2 antigens can be inserted in the sMVA vector to obtain the vaccine composition. The sequences of some antigens used herein are disclosed as follows. In one embodiment, the Spike (S) antigen sequence is based on the genome sequence of the NCBI SARS-CoV-2 reference strain (#NC_045512), isolated Wuhan-Hu-1, which encodes a S protein comprising 1273 amino acids. The DNA sequence/open reading frame (ORF) (5' to 3' end) is shown in FIG. 60, and the encoded protein sequence (N- to C-terminus) is shown in FIG. 61.

In another example, the SARS-CoV-2 S antigen sequence is based on the Wuhan-Hu-1 reference strain (#NC_045512) and optimized for stability in vaccinia by silent codon alteration to avoid 4 or more of the same nucleotides in consecutive order. The DNA/sequence/ORF (5' to 3' end) used in COH04SL1 (a.k.a., construct C15 and illustrated as sMVA-S in FIG. 5), COH04SL3 (a.k.a., construct C35 and illustrated as sMVA-N/S in FIG. 5), and COH04SL4 (a.k.a., construct C46 and illustrated as sMVA-S/N in FIG. 5), as well as in the clinical construct COH04S1 (FIG. 17, COH04S1 was derived from the C35 sMVA-N/S vaccine construct (FIG. 5) as illustrated in FIG. 57), is shown in FIG. 62, and the encoded protein sequence (N- to C-terminus) is shown in FIG. 63.

In one embodiment, the Nucleocapsid (N) antigen sequence is based on the genome sequence of the NCBI SARS-CoV-2 reference strain (#NC_045512), isolate Wuhan-Hu-1, which encodes a N protein composed of 419 amino acids. The DNA sequence/ORF (5' to 3' end) is shown in FIG. 64, and the encoded protein sequence (N- to C-terminus) is shown in FIG. 65.

In another example, the SARS-CoV-2 N antigen sequence is based on the Wuhan-Hu-1 reference strain (#NC_045512) and optimized for stability in vaccinia by silent codon alteration to avoid 4 or more of the same nucleotides in consecutive order. The DNA sequence/ORF (5' to 3' end) used in COH04SL2 (a.k.a., construct C13 and illustrated as sMVA-N in FIG. 5), COH04SL3 (a.k.a., construct C35 and illustrated as sMVA-N/S in FIG. 5), and COH04SL4 (a.k.a., construct C46 and illustrated as sMVA-S/N in FIG. 5), as well as in the clinical construct COH04S1 (FIG. 17, COH04S1 was derived from the C35 sMVA-N/S vaccine construct (FIG. 5) as illustrated in FIG. 57), is shown in FIG. 66, and the encoded protein sequence (N- to C-terminus) is shown in FIG. 67.

In another embodiment the SARS-CoV-2 S antigen sequence is modified to encode for a prefusion stabilized S antigen with 2P alteration (lysine and valine at amino acid positions 986 and 987 substituted with prolines). For example, the codon-optimized S antigen sequence disclosed above (based on the Wuhan-Hu-1 reference strain (#NC_045512) and optimized for vaccinia) is further modified to encode for such an S antigen. The DNA sequence/ORF (5' to 3' end) is shown in FIG. 68, and the encoded protein sequence (N- to C-terminus) is shown in FIG. 69.

In another embodiment, the SARS-CoV-2 S antigen sequence is modified to encode for a prefusion stabilized S antigen with 2P alteration (lysine and valine at amino acid positions 986 and 987 substituted with prolines) and mutated Furin cleavage site (RRAR amino acids at positions 682-685 substituted with GSAS). For example, the codon-optimized S antigen sequence disclosed above (based on the Wuhan-Hu-1 reference strain (#NC_045512) and optimized for vaccinia) is further modified to encode for such an S antigen. The DNA sequence/ORF (5' to 3' end) is shown in FIG. 70, and the encoded protein sequence (N- to C-terminus) is shown in FIG. 71.

In another embodiment the SARS-CoV-2 S antigen sequence is modified to encode for a prefusion stabilized S antigen with 2P alteration (lysine and valine at amino acid positions 986 and 987 substituted with prolines), mutated Furin cleavage site (RRAR amino acids at positions 682-685 substituted with GSAS), and 19 amino acid residues at the C-terminus (KFDEDDSEPVLKGVKLHYT, SEQ ID NO: 65) deleted to prevent endoplasmic reticulum retention and to enhance cell surface expression. For example, the codon-optimized S antigen sequence disclosed above (based on the Wuhan-Hu-1 reference strain (#NC_045512) and optimized for vaccinia) is further modified to encode for such an S antigen. The DNA sequence/ORF (5' to 3' end) is shown in FIG. 72, and the encoded protein sequence (N- to C-terminus) is shown in FIG. 73.

In another example the SARS-CoV-2 S antigen sequence is fully codon-optimized for human expression, additionally optimized for stability in vaccinia by silent codon alteration to avoid 4 or more of the same nucleotides in consecutive order, and encodes for an S antigen with mutated Furin cleavage site and stabilizing 2P mutation, as shown in FIG. 74.

In another example the SARS-CoV-2 S antigen sequence is fully codon-optimized for Vaccinia virus expression, additionally optimized for stability in vaccinia by silent codon alteration to avoid 4 or more of the same nucleotides in consecutive order, and encodes for an S antigen with mutated Furin cleavage site and stabilizing 2P mutation, as shown in FIG. 75.

In one example the SARS-CoV-2 N antigen sequence is fully codon-optimized for human expression and additionally optimized for stability in vaccinia by silent codon alteration to avoid 4 or more of the same nucleotides in consecutive order, as shown in FIG. 76.

In another example the SARS-CoV-2 N antigen sequence is fully codon-optimized for Vaccinia virus expression and additionally optimized for stability in vaccinia by silent codon alteration to avoid 4 or more of the same nucleotides in consecutive order, as shown in FIG. 77.

In another embodiment, the SARS-CoV-2 S antigen sequence encodes only for the S1 domain that encompasses 698, 685, or 680 amino acid residues or even shorter amino acid sequences of the N-terminus of the S protein. For example, the S antigen sequence based on the Wuhan reference strain (#NC_045512) and optimized for stability in vaccinia as disclosed above encodes for an S1 domain encompassing 698 amino acid residues of the N-terminus of the SARS-CoV-2 S antigen. The DNA sequence/ORF (5' to 3' end) is shown in FIG. 78, and the encoded protein sequence (N- to C-terminus) is shown in FIG. 79.

In another example the SARS-CoV-2 S antigen sequence based on the Wuhan reference strain (#NC_045512) and optimized for stability in vaccinia as disclosed above encodes for an S1 domain encompassing 680 amino acid residues of the SARS-CoV-2 S antigen. The DNA sequence/ORF (5' to 3' end) is shown in FIG. 80, and the encoded protein sequence (N- to C-terminus) is shown in FIG. 81.

In another embodiment, the SARS-CoV-2 S antigen sequence encodes only for the receptor binding domain (RBD) that encompasses amino acid residues 331 to 524 or 319 to 541 of the S antigen, or a longer or shorter fragment thereof comprising the RBD domain. For example, the S antigen sequence based on the Wuhan reference strain (#NC_045512) and optimized for stability in vaccinia as disclosed above encodes for an RBD encompassing amino acid residues 331-524 of the SARS-CoV-2 S antigen fused to the signal peptide of the S antigen (C-terminal 13 amino acids comprising MFVFLVLLPLVSS, SEQ ID NO: 41). The DNA sequence/ORF (5' to 3' end) is shown in FIG. 82, and the encoded protein sequence (N- to C-terminus) is shown in FIG. 83.

In another embodiment, the SARS-CoV-2 S antigen sequence is based on the Wuhan reference strain (#NC_045512) and optimized for stability in vaccinia as disclosed above encodes for an RBD encompassing amino acid residues 319-541 of the SARS-CoV-2 S antigen fused to the signal peptide of the S antigen (C-terminal 13 amino acids comprising MFVFLVLLPLVSS, SEQ ID NO: 41). The DNA sequence/ORF (5' to 3' end) is shown in FIG. 84, and the encoded protein sequence (N- to C-terminus) is shown in FIG. 85.

In another embodiment the SARS-CoV-2 S antigen sequence encodes for an S antigen that contains one or more mutations or alterations at any amino acid position of the S antigen. These mutations or alterations may include amino acid substitutions, insertion, or deletions. The mutations may be involved in immune evasion that renders SARS-CoV-2 resistant to certain humoral and cellular immune responses, including neutralizing antibodies (NAb). The mutations may include one or more alterations in the RBD domain (amino acid residues 319-541) that mediates binding to and entry into host cells and that is the primary target of NAb. For example, the RBD mutations may include an asparagine to tyrosine substitution at amino acid position 501 of the S antigen (N501Y); a glutamic acid to lysine substitution at amino acid position 484 of the S antigen (E484K); a glutamic acid to glutamine substitution at amino acid position 484 of the S antigen (E484Q); a lysine to asparagine substitution at amino acid position 417 of the S antigen (K417N); a lysine to threonine substitution at amino acid position 417 of the S antigen (K417T); a leucine to arginine substitution at amino acid position 452 of the S antigen (L452R); a serine to asparagine substitution at amino acid position 477 of the S antigen (S477N); an asparagine to lysine substitution at amino acid position 439 of the S antigen (N439K); a serine to proline substitution at amino acid position 494 of the S antigen (S494P); an alanine to serine substitution at amino acid position 520 of the S antigen (S520S); a tyrosine to phenylalanine substitution at amino acid position 453 of the S antigen (Y453F).

In another embodiment the SARS-CoV-2 S antigen sequence encodes for an S antigen that contains or includes a dominant mutation occurring in SARS-CoV-2 and many of its emerging variants, which is the D614G mutation (aspartic acid to glycine substitution at amino acid position 614 of the S antigen).

In another embodiment the SARS-CoV-2 antigen sequence encodes for an S antigen that includes all mutations, a subset of the mutations, or a combination of the mutations occurring in the emerging SARS-CoV-2 variants that are of particular concern (variants of concern, or VOC), such as the B.1.351 variant lineage first identified in South Africa, the B.1.1.7 variant lineage first identified in the United Kingdom (UK), the P.1 variant lineage first identified in Brazil, the B.1.429+B.1.427 variant lineage identified in California, or the B.1.617 variant lineage first identified in India. Modified antigen sequences with mutations based on other SARS-CoV-2 variant lineages described by the PANGO tool (cov-lineages.org) or under GISAID (gisaid.org) may also be used. For example, the SARS-CoV-2 S antigen sequence may encode for an S antigen that contains mutations of the B.1.351 variant lineage identified in South Africa variant, including N501Y, E484K, and K417N substitutions in the RBD domain, the D614G mutation, a leucine to phenylalanine substitution at amino acid position 18 of the S antigen (L18F), an aspartic acid to alanine substitution at amino acid position 80 of the S antigen (D80A), an aspartic acid to glycine substitution at amino acid position 215 of the S antigen (D215G), a deletion of three amino acids at position 242-244 (leucine, alanine, leucine) of the S antigen (Del242-244), an arginine to isoleucine substitution at amino acid position 246 of the S antigen (R246I), and an alanine to valine substitution at amino acid position 701 of the S antigen (A701V).

In another embodiment, the SARS-CoV-2 S antigen sequence encodes for an S antigen that includes mutations of the B.1.1.7 variant lineage identified in the UK, including N501Y in the RBD, D614G, a deletion of two amino acids at positions 69 and 70 (histidine, valine) of the S antigen (Del69/70), a deletion of the tyrosine residue at position 144 of the S antigen (Del144), an alanine to aspartic acid substitution at amino acid position 570 of the S antigen (A570D), a proline to histidine substitution at amino acid position 681 of the S antigen (P681H), a threonine to isoleucine substitution at amino acid position 716 of the S antigen (T716I), a serine to alanine substitution at amino acid position 982 of the S antigen (S982A), and an aspartic acid to histidine substitution at amino acid position 1118 of the S antigen (D1118H). The encoded S antigen based on the UK variant may additionally include E484K and K417N or K417T or other mutations in the RBD domain as disclosed above.

In another embodiment the SARS-CoV-2 S antigen sequence encodes for an S antigen that includes the mutations of the P.1 variant lineage identified in Brazil, including D614G, N501Y, E484K, K417T, L18F, a threonine to asparagine substitution at amino acid position 20 of the S antigen (T20N), a proline to serine substitution at amino acid position 26 of the S antigen (P26S), an aspartic acid to tyrosine substitution at amino acid position 138 of the S antigen (D138Y), an arginine to serine substitution at amino acid position 190 of the S antigen (R190S), a histidine to tyrosine substitution at amino acid position 655 of the S antigen (H655Y), a threonine to isoleucine substitution at amino acid position 1027 of the S antigen (T1027I), and a valine to phenylalanine substitution at amino acid position 1176 of the S antigen (V1176F). The encoded S antigen may additionally include other mutations in the RBD domain as disclosed above, such as L452R or Y453F.

In another embodiment, the SARS-CoV-2 S antigen sequence encodes for an S antigen that includes the mutations of B.1.429+B.1.427 variant lineage identified in California, including D614G, L452R in the RBD, a serine to isoleucine substitution at amino acid position 13 of the S antigen (S13I), and a tryptophan to cysteine mutation at amino acid position 152 of the S antigen (W152C). The encoded S antigen based on the Southern California variant may additionally include N501Y, E484K, E484Q, or other RBD mutations.

In another embodiment, the SARS-CoV-2 antigen sequence encodes for an S antigen that contains different combinations of the mutations that occur in the VOC. For example, the S antigen sequence may encode for an S antigen that combines the mutations or only a subset of the mutations that occur in the B.1.429+B.1.427 and B.1.1.7 variant lineages, the B.1.429+B.1.427 and B.1.351 variant lineages, the B.1.429+B.1.427 and P.1 variant lineages, the B.1.1.7 and B.1.351 lineages, the B.1.1.7 and P.1 lineages, the B.1.351 and P.1 lineages, or other combinations of these lineages. These combinations of mutations may additionally include any of the RBD mutations as disclosed above such as N501Y, E484K, K417N, K417T, L452R, S477N, N439K, S520S, and Y453F.

In another embodiment, the codon-optimized SARS-CoV-2 S antigen sequence disclosed above (based on the Wuhan-Hu-1 reference strain (#NC_045512) and optimized for vaccinia) is further modified to encode for an S antigen that includes mutations of the B.1.351 variant lineage identified in South Africa (N501Y, E484K, K417N, L18F, D80A, D215G, Del242-244, R246I, D614G, A701V). The DNA sequence/ORF (5' to 3' end) is shown in FIG. 86, and the encoded protein sequence (N- to C-terminus) is shown in FIG. 87.

In another example the codon-optimized SARS-CoV-2 S antigen sequence disclosed above (based on the Wuhan- Hu-1 reference strain (#NC_045512) and optimized for vaccinia) is further modified to encode for an S antigen that includes mutations of the B.1.1.7 variant lineage identified in the UK (N501Y, Del69/70, Del144, A570D, D614G, P681H, T716I, S982A, D1118H). The DNA sequence/ORF (5' to 3' end) is shown in FIG. 88, and the encoded protein sequence (N- to C-terminus) is shown in FIG. 89.

In another example the codon-optimized SARS-CoV-2 S antigen sequence disclosed above (based on the Wuhan-Hu-1 reference strain (#NC_045512) and optimized for vaccinia) is further modified to encode for an S antigen that includes mutations of the B.1.429+B.1.427 variant lineage identified in California (D614G, L452R, S13I, W152C). The DNA sequence/ORF (5' to 3' end) is shown in FIG. 90, and the encoded protein sequence (N- to C-terminus) is shown in FIG. 91.

In another example the codon-optimized SARS-CoV-2 S antigen sequence disclosed above (based on the Wuhan-Hu-1 reference strain (#NC_045512) and optimized for vaccinia) is further modified to encode for an S antigen that includes mutations of P.1 variant lineage identified in Brazil (N501Y, E484K, K417T, L18F, T20N, P26S, D138Y, R190S, H655Y, T1027I, V1176F). The DNA sequence/ORF (5' to 3' end) is shown in FIG. 92, and the encoded protein sequence (N- to C-terminus) is shown in FIG. 93.

In another embodiment the SARS-CoV-2 S antigen sequence is further modified to encode for an S antigen based on the B.1.429+B.1.427, B.1.1.7, B.1.351, or P.1 variant lineages that includes additionally 2P stabilizing mutations (lysine 986 and valine 987 substituted with prolines (K986P and V987P), a mutated Furin cleavage site (682-685 RRAR to GSAS), and/or C-terminal 19 amino acid residues (KFDEDDSEPVLKGVKLHYT, SEQ ID NO: 65) deleted.

In another embodiment different SARS-CoV-2 antigen sequences with different codon usage are utilized to encode for different S antigens based on the original Wuhan-Hu-1 reference strain and the B.1.429+B.1.427, B.1.1.7, B.1.351, or P.1 variant lineages. These antigen sequences can be inserted together into one sMVA vector or into separate sMVA vectors using different insertion sites (e.g. Del2, Del3, IGR69/70). For example, the following three antigen sequences maybe used to co-express the S antigens of the Wuhan-Hu-1 reference strain, the South African variant B.1.351, and the UK variant B.1.1.7.

The sequence encoding the S antigen of the Wuhan-Hu-1 reference strain is shown in FIG. 94, the sequence encoding the S antigen of the South African variant B.1.351 is shown in FIG. 95, and the sequence encoding the S antigen of the UK variant B.1.1.7 is shown in FIG. 96.

In another embodiment multiple different SARS-CoV-2 RBD domains (amino acid residues 319-541) based on the original Wuhan-Hu-1 reference strain, or the B.1.429+B.1.427, B.1.1.7, B.1.351, P.1, or B.1.617 variants, or other emerging SARS-CoV-2 variants can be co-expressed either from one vector or from separate vectors though the utilization of different codon usage. These RBD domains can be co-expressed each by its one Vaccinia promoter (e.g., mH5) or co-expressed through polycistronic expression constructs in which the individual RBD domains are connected through different linkers sequences (e.g., GS linkers) or 2A peptides of picornaviruses mediating ribosomal skipping. In addition, one or more of these domains can be fused at the N-terminus to the SARS-CoV-2 signal sequence (first 13 or 16 N-terminal amino acids of the S protein), at the N- or C-terminus to the T4 fibritin Foldon domain (GYIPEAPRDGQAY-VRKDGEWVLLSTFL, SEQ ID NO: 45) that mediates trimerization, and/or at the C-terminus fused to the trans-membrane domain (TM) and cytoplasmic domain (CT) of the SARS-CoV-2 S protein, wherein the last 19 amino acids of the CT domain may be deleted to avoid ER retention and enhance cell surface expression.

For example, the RBD domain of the Wuhan-Hu-1 reference strain, the RBD domain of the B.1.351 variant, and an RBD domain combining N501Y and L452R mutations of the B.1.1.7 and B.1.429+B.1.427 variants can be co-expressed through a triple polycistronic expression construct which comprises at the N-terminus a signal peptide of the S antigen (MFVFLVLLPLVSSQCV, SEQ ID NO: 41) and in which the RBD domains are connected through GS linkers such as GSGSGS (SEQ ID NO: 42). The DNA sequence/ORF (5' to 3' end) is shown in FIG. 97, and the encoded protein sequence (N- to C-terminus) is shown in FIG. 98.

In another example, the RBD domain of the Wuhan-Hu-1 reference strain, the RBD domain of the B.1.351 variant, and a RBD domain combining the N501Y and L452R mutations of the B.1.1.7 and B.1.429+B.1.427 variants can be co-expressed through a triple polycistronic expression construct comprising at the N-terminus a signal peptide of the S antigen (MFVFLVLLPLVSSQCV, SEQ ID NO: 41 and at the C-terminus a T4 Foldon domain (GYIPEAPRDGQAY-VRKDGEWVLLSTFL, SEQ ID NO: 45) and in which the RBD domains are connected through GS linkers such as GSGSGS (SEQ ID NO: 42). The DNA sequence/ORF (5' to 3' end) is shown in FIG. 99, and the encoded protein sequence (N- to C-terminus) is shown in FIG. 100.

In another example, the RBD domain of the Wuhan-Hu-1 reference strain, the RBD domain of the B.1.351 variant, and an RBD domain combining N501Y and L452R mutations of the B.1.1.7 and B.1.429+B.1.427 variants can be co-expressed through a polycistronic expression construct in which each RBD domain comprises at the N-terminus a signal peptide of the S antigen (MFVFLVLLPLVSSQCV, SEQ ID NO: 41) and in which the RBD domains are connected through GS linkers such as GSGSGS (SEQ ID NO: 42) and P2A and T2A peptides. The DNA sequence/ORF (5' to 3' end) is shown in FIG. 101, and the encoded protein sequence (N- to C-terminus) is shown in FIG. 102.

In another example, the RBD domain of the Wuhan-Hu-1 reference strain, the RBD domain of the B.1.351 variant, and a RBD domain combining N501Y and L452R mutations of the B.1.1.7 and B.1.429+B.1.427 variants can be co-expressed through a polycistronic expression construct in which the RBD domains are connected through GS linkers (GSGSGS, SEQ ID NO: 42) and P2A and T2A peptides and in which each RBD domain is fused at the N-terminus to a S signal peptide (MFVFLVLLPLVSSQCV, SEQ ID NO: 41) and at the C-terminus to a T4 Foldon domain (GYIPEAPRDGQAYVRKDGEWVLLSTFL, SEQ ID NO: 45). The DNA sequence/ORF (5' to 3' end) is shown in FIG. 103, and the encoded protein sequence (N- to C-terminus) is shown in FIG. 104.

In another example, the RBD domain of the Wuhan-Hu-1 reference strain, the RBD domain of the B.1.351 variant, and an RBD domain combining N501Y and L452R mutations of the B.1.1.7 and B.1.429+B.1.427 variants can be co-expressed through a polycistronic expression construct comprising at the N-terminus a signal peptide of the S antigen (MFVFLVLLPLVSSQCV, SEQ ID NO: 41) and at the C-terminus TM and CT domains (without the last 19 amino acids) of the S antigen and in which the RBD domains are connected through GS linkers such as GSGSGS (SEQ ID NO: 42). The DNA sequence/ORF (5' to 3' end) is shown in FIG. 105, and the encoded protein sequence (N- to C-terminus) is shown in FIG. 106.

In another example, the RBD domain of the Wuhan-Hu-1 reference strain, the RBD domain of the B.1.351 VOC, and an RBD domain combining N501Y and L452R mutations of the B.1.1.7 and B.1.429+B.1.427 VOC can be co-expressed through a polycistronic expression construct in which each of the RBD domains comprises at the N-terminus a signal peptide of the S protein (MFVFLVLLPLVSSQCV, SEQ ID NO: 41) and at the C-terminus with TM domain and CT domain (without the last 19 amino acids KFDEDD-SEPVLKGVKLHYT, SEQ ID NO: 65) of the S antigen and in which the RBD domains are connected through GS linkers such as GSGSGS (SEQ ID NO: 42) and P2A and T2A peptide sequences. The DNA sequence/ORF (5' to 3' end) is shown in FIG. 107, and the encoded protein sequence (N- to C-terminus) is shown in FIG. 108.

In another embodiment, the SARS-CoV-2 N antigen sequence encodes for an N antigen which comprises one or more mutations at different amino acid positions of the N protein. These mutations or alterations may include amino acid substitutions, insertions, or deletions. The mutations maybe based on the N-specific mutations that occur in the South African VOC B.1.351, the California variant B.1.429+B.1.427, the UK variant B.1.1.7, the Brazilian variant P.1, the Indian variant B.1.617, or any other emerging SARS-CoV-2 VOC.

For example, the SARS-CoV-2 N antigen sequence encodes for an N antigen that includes the N-specific mutations that occur in the B.1.1.7 variant lineage identified in the UK. These mutations include an aspartic acid to leucine substitution at amino acid position 3 of the N protein (D3L), a serine to phenylalanine substitution at amino acid position 235 of the N protein (S235F), an arginine to lysine substitution at amino acid position 203 of the N protein (R203K), and a glycine to arginine substitution at amino acid position 204 of the N protein (G204R). The DNA sequence/ORF (5' to 3' end) is shown in FIG. 109, and the encoded protein sequence (N- to C-terminus) is shown in FIG. 110.

In another example, the codon-optimized SARS-CoV-2 N antigen sequence encodes for an N antigen that includes the N-specific mutations that occur in the B.1.351 variant lineage identified in South Africa. This includes a threonine to isoleucine substitution at amino acid position 205 of the N protein (T205I). The DNA sequence/ORF (5' to 3' end) is shown in FIG. 111, and the encoded protein sequence (N- to C-terminus) is shown in FIG. 112.

In another example, the codon-optimized SARS-CoV-2 N antigen sequence encodes for an N antigen that includes the N-specific mutations that occur in the P.1 variant lineage identified in Brazil. This includes a proline to arginine substitution at amino acid position 80 of the N protein (P80R), as well as R203K and G204R. The DNA sequence/ORF (5' to 3' end) is shown in FIG. 113, and the encoded protein sequence (N- to C-terminus) is shown in FIG. 114.

In another embodiment, the codon-optimized SARS-CoV-2 S antigen sequence disclosed above (based on the Wuhan-Hu-1 reference strain (#NC_045512) and optimized for vaccinia) is further modified to encode for an S antigen that includes mutations of the B.1.617 variant lineage identified in India. This may include L452R and E484Q mutations in the RBD domain, D614G, a glycine to aspartic acid substitution at amino acid position 142 of the S protein (G142D), a glutamic acid to lysine substitution at amino acid position 154 of the S protein (E154K), a proline to arginine substitution at amino acid position 681 of the S protein (P681R), a glutamine to histidine substitution at amino acid position 1071 of the S protein (Q1071H), and a histidine aspartic acid substitution at amino acid position 1101 of the S protein (H1101D). The DNA sequence/ORF (5' to 3' end) is shown in FIG. 115, and the encoded protein sequence (N- to C-terminus) is shown in FIG. 116.

In another embodiment, the codon-optimized SARS-CoV-2 S antigen sequence disclosed above (based on the Wuhan-Hu-1 reference strain (#NC_045512) and optimized for vaccinia) is further modified to encode for an S antigen that includes mutations or a subset of the mutations of the B.1.617 variant lineage, including L452R, E484Q, D614G, G142D, E154K, P681R, Q1071H, and H1101D, a threonine to lysine substitution at amino acid position 478 (T478K), a threonine to isoleucine substitution at amino acid position 95 (T95I), a threonine to arginine substitution at amino acid position 19 (T19R), a lysine to threonine substitution at amino acid position 77 (K77T), a aspartic acid to asparagine substitution at amino acid 950 (D950N), an arginine to threonine substitution at amino acid position 21 (R21T), a glutamine to histidine substitution at amino acid position 218 (Q218H), a deletion of glutamic acid and phenylalanine at amino acid position 156 and 157 (Del156-157), and an arginine to glycine substitution at amino acid position 158 (R158G).

In another embodiment, the codon-optimized SARS-CoV-2 N antigen sequence encodes for an N antigen that includes the N-specific mutations that occur in the B.1.617 variant lineage identified in India. This may include an arginine to methionine substitution at amino acid position 203 of the N protein (R203M) and an aspartic acid to tyrosine substitution at amino acid position 377 of the N protein (D377Y). The DNA sequence/ORF (5' to 3' end) is shown in FIG. 117, and the encoded protein sequence (N- to C-terminus) is shown in FIG. 118.

In certain embodiments, the DNA sequences of two or more antigens, subunits or fragments thereof may be inserted into a single MVA insertion site or into two or more MVA insertion sites, which may be located on the same sMVA fragment or on different sMVA fragments. For example, the DNA sequences of two or more antigens, subunits or fragments thereof can be inserted in two different MVA insertion sites, both located on sMVA F1. In another example, the DNA sequences of two or more antigens, subunits or fragments thereof can be inserted into two different MVA insertion sites, one located on sMVA F1 and the other located on sMVA F2.

These insertion sites may include commonly used insertion sites such as the MVA deletion 2 (Del2) site, the intergenic region (IGR) between open reading frame (ORF) 44L and 45L (IGR44/45), the IGR between ORF 69R and 70L (IGR69/70), the IGR between 64L and 65L (IGR64/65), the Thymidine Kinase (TK) gene insertion site, or the MVA Deletion 3 (Del3) site, or any other MVA deletion site, intergenic region, or gene insertion site (ORF numbers are based on MVA strain Antoine (Accession #U94848)).

The sMVA or rsMVA expressing coronavirus antigens disclosed herein may be part of a vaccine composition that may be used in methods to treat or prevent viral infection. The vaccine composition as described herein may comprise a therapeutically effective amount of the sMVA or rsMVA as disclosed herein, and further comprising a pharmaceutically acceptable carrier according to a standard method. Examples of acceptable carriers include physiologically acceptable solutions, such as sterile saline and sterile buffered saline.

In some embodiments, the vaccine or pharmaceutical composition may be used in combination with a pharmaceutically effective amount of an adjuvant to enhance the prophylactic or therapeutic effects. Any immunologic adjuvant that may stimulate the immune system and increase the response to a vaccine, without having any specific antigenic effect itself may be used as the adjuvant. Many immunologic adjuvants mimic evolutionarily conserved molecules known as pathogen-associated molecular patterns (PAMPs) and are recognized by a set of immune receptors known as Toll-like Receptors (TLRs). Examples of adjuvants that may be used in accordance with the embodiments described herein include Freund's complete adjuvant, Freund's incomplete adjuvant, double stranded RNA (a TLR3 ligand), LPS, LPS analogs such as monophosphoryl lipid A (MPL) (a TLR4 ligand), flagellin (a TLR5 ligand), lipoproteins, lipopeptides, single stranded RNA, single stranded DNA, imidazoquinolin analogs (TLR7 and TLR8 ligands), CpG DNA (a TLR9 ligand), Ribi's adjuvant (monophosphoryl-lipid A/trehalose dicorynomycolate), glycolipids (α-GalCer analogs), unmethylated CpG islands, oil emulsion, liposomes, virosomes, saponins (active fractions of saponin such as QS21), muramyl dipeptide, alum, aluminum hydroxide, squalene, BCG, cytokines such as GM-CSF and IL-12, chemokines such as MIP 1-α and RANTES, activating cell surface ligands such as CD40L, N-acetylmuramine-L-alanyl-D-isoglutamine (MDP), and thymosin α1. The amount of adjuvant used can be suitably selected according to the degree of symptoms, such as softening of the skin, pain, erythema, fever, headache, and muscular pain, which might be expressed as part of the immune response in humans or animals after the administration of this type of vaccine.

In further embodiments, use of various other adjuvants, drugs or additives with the vaccine of the invention, as discussed above, may enhance the therapeutic effect achieved by the administration of the vaccine or pharmaceutical composition. The pharmaceutically acceptable carrier may contain a trace amount of additives, such as substances that enhance the isotonicity and chemical stability. Such additives should be non-toxic to a human or other mammalian subject in the dosage and concentration used, and examples thereof include buffers such as phosphoric acid, citric acid, succinic acid, acetic acid, and other organic acids, and salts thereof; antioxidants such as ascorbic acid; low molecular weight (e.g., less than about 10 residues) polypeptides (e.g., polyarginine and tripeptide) proteins (e.g., serum albumin, gelatin, and immunoglobulin); amino acids (e.g., glycine, glutamic acid, aspartic acid, and arginine); monosaccharides, disaccharides, and other carbohydrates (e.g., cellulose and derivatives thereof, glucose, mannose, and dextrin), chelating agents (e.g., EDTA); sugar alcohols (e.g., mannitol and sorbitol); counterions (e.g., sodium); nonionic surfactants (e.g., polysorbate and poloxamer); antibiotics; and PEG.

The vaccine or pharmaceutical composition containing the sMVA or rsMVA disclosed herein may be stored as an aqueous solution or a lyophilized product in a unit or multiple dose container such as a sealed ampoule or a vial.

The sMVA, rsMVA, vaccine or pharmaceutical composition disclosed herein can be used to stimulate SARS-CoV-2-specific humoral (binding antibodies, neutralizing antibodies) and cellular (CD4+ and CD8+ T cells) immune responses for the treatment or prevention of SARS-CoV-2 infection in animal models and humans. They also can be used to produce and isolate antibody responses that can be utilized for the treatment of or passive immunization against SARS-CoV-2 infections.

Disclosed herein is an sMVA vaccine composition. COH04S1 co-expresses SARS-CoV-2 Spike and Nucleocapsid, 2 antigens implicated in protective immunity, and shows very promising immune responses in mice, hamsters, ferrets and monkeys. Favorable pre-IND FDA response was received. FDA agreed that synthetic sMVA is equivalent to traditional MVA, and that No requirement for IND-directed tox studies. City of Hope's cGMP manufacturing facilities produced materials for Phase 1 and 2 studies. Up to 122 volunteers, age 18-54, were dosed, and 55 volunteers received either 1 or 2 doses.

The vaccine composition also comprises the N antigen, which elicits strong T cell response. The vaccine composition lacks gender dependency and is effective across age groups, e.g., from 2-year old to 75-year old. Strong immunogenicity was achieved even at lowest evaluated clinical dose. The vaccine composition achieved protection from severe disease in hamsters. The vaccine composition exhibits Th1-biased antibody and T cell response.

In some embodiments, the vaccine composition disclosed herein is formulated for nasal delivery for mucosal protection. Alternatively, the vaccine composition disclosed herein is formulated for intraperitoneal (IP), intramuscular (IM) or intranasal (IN) administration to induce strong immune responses in a subject. In certain embodiments, the vaccine composition is administered at $1 \times 10^7$ PFU to $10 \times 10^8$ PFU per dose, $1-10 \times 10^8$ PFU per dose, or $1-5 \times 10^8$ PFU per dose. In some embodiments, the vaccine composition is administered at about $1 \times 10^7$ PFU per dose, about $2 \times 10^7$ PFU per dose, about $3 \times 10^7$ PFU per dose, about $4 \times 10^7$ PFU per dose, about $5 \times 10^7$ PFU per dose, about $6 \times 10^7$ PFU per dose, about $7 \times 10^7$ PFU per dose, about $8 \times 10^7$ PFU per dose, about $9 \times 10^7$ PFU per dose, about $1 \times 10^8$ PFU per dose, about $2 \times 10^8$ PFU per dose, about $3 \times 10^8$ PFU per dose, about $4 \times 10^8$ PFU per dose, about $5 \times 10^8$ PFU per dose, about $6 \times 10^8$ PFU per dose, about $7 \times 10^8$ PFU per dose, about $8 \times 10^8$ PFU per dose, about $9 \times 10^8$ PFU per dose, or about $10 \times 10^8$ PFU per dose. In certain embodiments, the vaccine composition is administered to a subject in a single dose. In certain embodiments, the vaccine composition is administered to a subject in a first dose, followed by a booster dose. The vaccine composition disclosed herein stimulates potent humoral and cellular immune responses against SARS-CoV-2 upon administration to a subject.

As demonstrated in the working examples, healthy adults immunized with COH04S1 at a dose of $1 \times 10^7$ PFU developed binding antibodies to S, RBD, N and neutralizing antibodies, as well as functional T Cell responses to S and N antigens.

Also illustrated herein is pre-clinical vaccine production process from the initial virus reconstitution to the generation of the final pre-clinical virus stock, as illustrated in FIG. 56. The process includes the steps of transfection/infection with plasmids containing sMVA fragments, sMVA virus reconstitution, primary small scale expansion, primary large scale expansion, primary in vivo testing for immunogenicity, efficacy, and safety, plaque purification, expansion of virus isolates, secondary small scale expansion, secondary large scale expansion, and final in vitro and in vivo testing, as demonstrated in the working examples. This process can be further modified, improved, or optimized based on the production needs using common knowledge in the field.

Steps 1 and 2: Transfection/Infection and sMVA Virus Reconstitution

The three plasmids containing the three sMVA fragments F1-F3 (unmodified, modified, or a combination thereof) are isolated from E. coli by alkaline lysis. The isolated plasmids are co-transfected by Fugene HD lipid-based transfection reagent (Roche) into 60-70% confluent BHK-21 cells (ATCC® CCL-10™) that have been seeded the day before in a 6-well plate tissue culture format and grown in minimum essential medium (MEM, Gibco) with 10% fetal bovine serum (MEM10) at 37° C. in a 5% $CO_2$ incubator. At 4 hours post transfection, the BHK-21 cells are infected at approximately 0.1 to 1 multiplicity of infection (MOI) with FPV (ATCC VR-2553) to initiate sMVA virus transcription and reconstitution. The transfected/infected BHK-21 cells are incubated for 2 days in MEM10 in a 6-well tissue culture plate at 37° C. in a 5% $CO_2$ incubator and every other day transferred, re-seeded, and grown for two days in larger tissue culture plates over a period of 8-12 days as illustrated in FIG. 56 (Step 2) until most or all of the BHK-21 cells show signs of sMVA virus infection. Characteristic MVA viral plaque formation and cytopathic effects (CPEs) indicating sMVA virus reconstitution is usually detected at 4-8 days post transfection/infection. Fully infected BHK-21 cell monolayers are usually visible at 8-12 days post transfection/infection. sMVA virus from the infected BHK-21 cell monolayers are prepared in MEM with 2% FBS (MEM2) by 3 cycles of conventional freeze/thaw method and stored at −80° C. sMVA from these initial virus stocks is titrated on BHK-21 cells and usually characterized by various methods (PCR, Western Blot (WB), flow cytometry (FC)) to confirm sMVA reconstitution and antigen expression.

Steps 3 and 4: Primary Small and Large Scale Expansion

To produce larger virus amounts for more vigorous in vitro and in vivo testing, the reconstituted sMVA virus from the initial virus stocks (Steps 1 and 2) is expanded in a two-step process, involving a first small-scale expansion on BHK-21 cells and a subsequent large-scale expansion on chicken embryo fibroblast (CEF) cells. For small scale expansion (step 3), BHK-21 cells seeded in 5×150 mm tissue culture dishes are allowed to grow to 80-90% confluency and infected at 0.02 MOI with the sMVA from the initial virus stocks. The infected BHK-21 cells are incubated for 2-3 days in MEM10 at 37° C. in a 5% $CO_2$ incubator. Virus stocks from the small-scale expansion are prepared by 3 cycles of freeze/thaw method, stored in MEM2 in a −80° C. freezer, and subsequently titrated on BHK-21 cells. sMVA virus from the small-scale expansion is characterized in vitro (PCR, WB, FC) to verify identity, genome reconstitution, and antigen expression. At this point of the development process, the sMVA virus may also undergo stability testing following propagation of 5-10 passages on CEF. For large scale expansion (step 4), freshly prepared CEF seeded in 30×150 mm tissue culture dishes are allowed to grow to 70-90% confluency and infected at 0.02 MOI with the sMVA virus prepared from the small-scale expansion. The infected CEF cells are grown for 2-3 days in MEM10 at 37° C. in a 5% $CO_2$ incubator. Virus from the large-scale expansion is prepared by 36% sucrose density ultracentrifugation, stored at −80° C. in 1 mM Tris-HCl (pH 9), and subsequently titrated on CEF cells. The purified virus is characterized in vitro by PCR, WB, and FC (or other methods) to confirm identity, fidelity of genome reconstitution, and antigen expression.

Step 5: Primary In Vivo Testing

Following in vitro characterization, the purified virus from the large-scale expansion is used for in vivo studies to assess immunogenicity, protection against challenge, and safety of the vaccine candidates in different animal models. This may include studies in mice, but also studies in other animal models such as hamsters, ferrets, or non-human primates. Dose escalation and immunization routes can be tested to assess optimal conditions for immunogenicity, and protection against viral challenge.

Steps 6 and 7: Plaque Purification and Expansion of Virus Isolates

For the transition into clinical production, selected sMVA vaccine constructs (selected based on results under step 4 and 5) are plaque purified, expanded, and re-tested by in vitro and in vivo studies. From this point on, all steps of the production process are conducted under serum-free conditions using VP-SFM medium (Gibco). For the plaque purification procedure (Step 6), freshly prepared CEF cells (80-90% confluent) seeded the day before in a 96-well tissue culture plate are infected at 10-100 PFU/plate with sMVA virus from the primary small-scale expansion (step 3). At 3-5 days post infection, the CEF cells of the 96-well plates are screened for single viral plaque formation per well and sMVA virus isolates from single wells are prepared by 3 cycles of freeze/thaw method. The virus isolates prepared from single wells are then expanded though infection of 80-90% confluent CEF cells seeded in 24-well tissue culture plate (1 virus isolate/well; Step 7, FIG. 56). At 2-4 days post infection, the virus isolates expanded in the 24-well plates are prepared by freeze/thaw method and further expanded at 1 isolate/dish on 80-90% confluent CEF seeded in 60 mm tissue culture dishes. The infected CEF cells are grown for 2-4 days and the expanded virus isolates harvested by freeze/thaw method and titrated on CEF. The titrated virus isolates (5-10) are then screened by in vitro testing using PCR, WB and FC to evaluate the identity, genome composition, and antigen expression of the single virus isolates.

Steps 8 and 9: Secondary Small and Large Scale Expansion

As a next step, selected plaque purified virus isolates of the sMVA vaccine candidates are further expanded in a two-step process involving a secondary small scale and secondary large scale expansion to produce large amounts of virus for vigorous in vitro and in vivo testing of the final isolates. The secondary expansion procedure principally follows the primary expansion procedure of the pre-clinical vaccine development process (FIG. 56, Steps 3 and 4 and steps 8 and 9), except that the secondary expansion procedure uses CEF cells grown exclusively under serum-free conditions (VP-SFM). Virus stocks from the large scale expansion are prepared by ultracentrifugation and stored at −80° C. in 1 mM Tris-HCl (pH 9). Final purified virus stocks are characterized in vitro by PCR, WB and FC to confirm the identity, genome composition, and antigen expression of the selected virus isolates of the sMVA vaccine candidates.

Step 10: Final In Vitro and In Vivo Testing

Following initial in vitro testing of the final products, the selected virus isolates are further evaluated in vitro for host range, replication kinetics, vaccine stability, and sequencing of the complete genome. In addition, immunogenicity, protection against challenge, and safety of the final virus isolates of the sMVA vaccine candidates are investigated in animal models (mice, or other animals).

Also disclosed herein are various prime-boost procedures. In some embodiments, a prime-boost procedure comprises a first and second immunizations or additional booster immunizations by the same sMVA vector encoding two or more SARS-CoV-2 antigen sequences of the Wuhan-Hu-1 reference strain or different variants of concern. In some embodiments, a prime-boost procedure comprises a first and second immunization or additional booster immunizations by a mixture of two or more sMVA vectors that encode two or more different SARS-CoV-2 antigen sequences selected from the Wuhan-Hu-1 reference strain and different variants of concern. In some embodiments, a prime-boost procedure that includes a first immunization with a sMVA vector encoding one or more SARS-CoV-2 antigen sequences of the Wuhan-Hu-1 reference strain and a second immunization with different sMVA vector encoding one or more SARS-CoV-2 antigen sequences of different variants of concern, or vice versa. In some embodiments, a prime-boost procedure comprises multiple immunization with an sMVA vector encoding one or more SARS-CoV-2 antigen sequences of the Wuhan-Hu-1 reference strain and multiple booster immunization with different sMVA vector encoding one or more SARS-CoV-2 antigen sequences of different variants of concern, or vice versa.

In this disclosure, COH04S1 has an sMVA-N/S vector construction as illustrated in FIG. 5 and FIG. 17. COH04S1 is the clinical product derived by double-plaque purification from the parental sMVA-N/S vector C35 (a.k.a., sMVA-N/S tv) as illustrated in FIG. 57. As used herein, the terms "sMVA-CoV2 vector" and "sMVA-SARS-CoV2 vector" may be used interchangeably to refer to sMVA vectors expressing one or more SARS-CoV2 antigens.

The following examples are intended to illustrate various embodiments of the invention. As such, the specific embodiments discussed are not to be constructed as limitations on the scope of the invention. It will be apparent to one skilled in the art that various equivalents, changes, and modifications may be made without departing from the scope of invention, and it is understood that such equivalent embodiments are to be included herein. Further, all references cited in the disclosure are hereby incorporated by reference in their entirety, as if fully set forth herein.

EXAMPLES

Materials and Methods

Cells and Viruses: BHK-21 (CCL-10), A549 (CCL-185), HeLa (CCL-2), 293T (CRL-1573), 143B (CRL-8303), MRC-5 (CCL-171), HEK293/17 (CRL11268), THP-1 (TIB-202), ARPE-19 (CRL-2302) were purchased from the American Type Culture Collection (ATCC) and grown according to ATCC recommendations. CEF were purchased from Charles River (10100795) and grown in minimum essential medium (MEM) with 10% FBS (MEM10). HEK293T/ACE2 were a kind gift of Pamela J. Bjorkman[46]. The wtMVA (NIH Clone 1) was used solely as a reference standard. To produce sMVA and wtMVA virus stocks, CEF were seeded in 30×150 mm tissue culture dishes, grown to about 70-90% confluency, infected at 0.02 multiplicity of infection (MOI) with sMVA or wtMVA. Two days post infection, purified virus was prepared by 36% sucrose density ultracentrifugation and virus resuspension in 1 mM Tris-HCl (pH 9)[47]. Virus stocks were stored at −80° C. Virus titers were determined on CEF by immunostaining of viral plaques at 16-24 hours post infection using polyclonal Vaccinia antibody. FPV stocks were produced following propagation on CEF using FPV strain TROVAC (ATCC VR-2553)[3] or HP1.441[4], kindly provided by Bernard Moss. FPV titers were evaluated on CEF by virus plaque determination. SARS-CoV-2 strain USA-WA1/2020 (BEI Resources NR-52281) was used in the focus reduction neutralization test (FRNT) assay[53].

Construction of sMVA fragments: The three about 60 kbp sMVA fragments (F1-F3; FIG. 1) comprising the complete MVA genome sequence reported by Antoine et al. (NCBI Accession #U94848) 4 were constructed as follows: sMVA F1 contained base pairs 191-59743 of the MVA genome sequence; sMVA F2 comprised base pairs 56744-119298 of the MVA sequence; and sMVA F3 included base pairs 116299-177898 of the reported MVA genome sequence[4]. A CR/HL/CR sequence arrangement composed of

```
                                    (SEQ ID NO: 66)
5'-TTT TTT TCT AGA CAC TAA ATA AAT AGT AAG

ATT AAA TTA ATT ATA AAA TTA TGT ATA TAA TAT

TAA TTA TAA AAT TAT GTA TAT GAT TTA CTA ACT

TTA GTT AGA TAA ATT AAT AAT ACA TAA ATT TTA

GTA TAT TAA TAT TAT AAA TTA ATA ATA CAT AAA

TTT TAG TAT ATT AAT ATT ATA TTT TAA ATA TTT

ATT TAG TGT CTA GAA AAA AA-3'
``` was added in the same orientation to both ends of each of the sMVA fragments, wherein the italicized letters indicate the duplex copy of the MVA terminal HL sequence and the underlined letters indicate the CR sequences. Notably, the CR/HL/CR sequences incorporated at the ITRs of sMVA F1 and F3 were added in identical arrangement as the CR/HL/CR sequences occur at the ITRs at the genomic junctions of putative MVA replication intermediates[4]. The sMVA fragments were produced and assembled by Genscript using chemical synthesis, combined with a yeast recombination system. All sMVA fragments were cloned into a yeast shuttle vector, termed pCCI-Brick, which contains a mini-F replicon for stable propagation of large DNA fragments as low copy BACs in *E. coli*. sMVA F1 and F3 were cloned and maintained in EPI300 *E. coli* (Epicentre), while sMVA F1 was cloned and maintained in DH10B *E. coli* (Invitrogen).

Antigen insertion: SARS-CoV-2 S and N antigen sequences were inserted into the sMVA fragments by En passant mutagenesis in GS1783 *E. coli* cells[48,49]. Briefly, transfer constructs were generated that consisted of the S or N antigen sequence with upstream mH5 promoter sequence and downstream Vaccinia transcription termination signal (TTTTTAT, SEQ ID NO: 67), and a kanamycin resistance cassette flanked by a 50 bp gene duplication was introduced into the antigen sequences. The transfer constructs were amplified by PCR with primers providing about 50 bp extensions for homologous recombination and the resulting PCR products were used to insert the transfer constructs into the sMVA DNA by a first Red-recombination reaction[48,49]. Primers

```
                                    (SEQ ID NO: 68)
5'-AAA AAA TAT ATT ATT TTT ATG TTA TTT TGT

TAA AAA TAA TCA TCG AAT ACG AAC TAG TAT AAA

AAG GCG CGC C-3'
and
                                    (SEQ ID NO: 69)
5'-GAA GAT ACC AAA ATA GTA AAG ATT TTG CTA

TTC AGT GGA CTG GAT GAT TCA AAA ATT GAA AAT

AAA TAC AAA GGT TC-3'
``` were used to insert the N antigen sequence into the Del2 site. Primers

```
                                    (SEQ ID NO: 70)
5'-ATA TGA ATA TGA TTT CAG ATA CTA TAT TTG

TTC CTG TAG ATA ATA ACT AAA AAT TTT TAT CTA

GTA TAA AAA GGC GCG CC-3'
and
                                    (SEQ ID NO: 71)
5'-GGA AAA TTT TTC ATC TCT AAA AAA AGA TGT

GGT CAT TAG AGT TTG ATT TTT ATA AAA ATT GAA

AAT AAA TAC AAA GGT TC-3'
``` were used to insert the S antigen sequence into the IGR69/90 insertion site primers. Primers

```
                                    (SEQ ID NO: 72)
5'-TTG GGG AAA TAT GAA CCT GAC ATG ATT AAG

ATT GCT CTT TCG GTG GCT GGT AAA AAA TTG AAA

ATA AAT ACA AAG GTT C-3'
and
                                    (SEQ ID NO: 73)
5'-ACA AAA TTA TGT ATT TTG TTC TAT CAA CTA

CCT ATA AAA CTT TCC AAA TAC TAG TAT AAA AAG

GCG CGC C-3'
``` were used to insert the S or N antigen sequence into the Del3 site. Underlined letters indicate the sequences used to produce about 50 bp extensions for homologous recombination. The S and N antigen sequences were based on the SARS-CoV-2 reference strain (NCBI Accession #NC_045512) and codon-optimized for Vaccinia[10,38]. Codon-optimized S and N gene sequences were synthesized by Twist Biosciences. The transfer constructs were amplified by PCR with Phusion polymerase (Thermo Fisher Scientific) using primers providing ~50 bp extensions for homologous recombination to insert the transfer constructs into the sMVA fragments by Red-recombination. Inserted antigen sequences were verified by PCR, restriction enzyme digestion, and sequencing. The amplified PCR products were purified using the Nucleo-Spin Gel and PCR clean-up kit (Macherey-Nagel) and 100 ng of PCR product was electroporated at 15 kV/cm, 25 μF, and 200Ω into 50 μL of recombination-competent GS1783 bacteria harboring the sMVA fragments. The bacteria were re-suspended in 1 mL of Luria-Bertani (LB) medium without antibiotics and incubated for 2 h at 32° C. and 220 r.p.m. After 2 h of incubation, the bacteria were streaked onto LB agar plates with 30 μg/mL chloramphenicol and 30 μg/mL kanamycin and incubated at 32° C. for 2 days. Bacterial clones harboring sMVA fragments with inserted antigen sequences at the respective MVA insertion sites were identified by PCR and restriction pattern analysis. To seamlessly remove the kanamycin resistance marker from the inserted antigen sequences by a I-SceI-mediated second Red-recombination reaction, 100 μL of an overnight culture of selected bacterial clones was added to 900 μL of LB medium containing 30 μg/mL chloramphenicol and incubated for 1.5-2 h at 32° C. and 220 r.p.m. Subsequently, 1 mL of LB containing 30 μg/mL chloramphenicol and 2% L-arabinose was added to induce the expression of the I-SceI homing endonuclease enzyme and to induce a double-strand break at the 50 bp gene duplication. The bacteria were incubated for 1 h at 32° C. and then transferred to a water bath and incubated for 30 min at 220 r.p.m. and 42° C. to induce the expression of the Red-recombination proteins and to mediate the removal of the kanamycin resistance marker by recombination of the 50 bp gene duplication. After an additional incubation period of the bacteria for 2 h at 32° C. and 220 r.p.m., the bacteria were streaked onto LB agar plates with 30 µg/mL chloramphenicol and 1% L-arabinose and incubated at 32° C. for 2 days. Bacterial clones harboring sMVA fragments with seamlessly removed kanamycin marker from the inserted antigen sequences were identified by PCR, restriction pattern analysis, and Sanger sequencing.

sMVA virus reconstitution: sMVA virus reconstitution from the three sMVA DNA plasmids in BHK-21 cells using FPV as a helper virus was performed as follows[8-10]. The three sMVA DNA plasmids were isolated from *E. coli* by alkaline lysis[50] and co-transfected into 60-70% confluent BHK-21 cells grown in 6-well plate tissue culture plates using Fugene HD transfection reagent (Roche) according to the manufacturer's instructions. At 4 hours post transfection, the cells were infected with approximately 0.1-1 MOI of FPV to initiate the sMVA virus reconstitution. The transfected/infected BHK-21 cells were grown for 2 days and then every other day transferred, re-seeded, and grown for additional two days in larger tissue culture formats over a period of 8-12 days until most or all of the cells showed signs of sMVA virus infection. Using this procedure, characteristic MVA viral plaque formation and cytopathic effects (CPEs) indicating sMVA virus reconstitution was usually detected at 4-8 days post transfection/infection. Fully infected BHK-21 cell monolayers were usually visible at 8-12 days post transfection/infection. sMVA virus from infected BHK-21 cell monolayers was prepared by conventional freeze/thaw method and passaged once on BHK-21 cells before producing purified virus stocks on CEF. sMVA or recombinant sMVA-CoV-2 vectors were reconstituted either with FPV HP1.441 (sMVA hp, sMVA-N/S, sMVA-S/N hp) or TROVAC (sMVA tv1 and tv2, sMVA-S tv, sMVA-N tv, sMVA-N/S tv, sMVA-S/N tv).

Host cell range: sMVA and wtMVA host cell range using various human cell lines (HeLa, 293T, MRC-5, A549, and 143B) BHK-21 cells, and CEF was determined as follows. The cells were seeded in 6-well plate tissue culture format and at 70-90% confluency infected in duplicates with 0.01 MOI of sMVA or wtMVA using MEM2. At 2 hours post infection, the cells were washed twice with PBS and incubated for two days in normal growth medium (as described under cells and viruses). After the incubation period, virus was prepared by conventional freeze/thaw method and the virus titers of each duplicate infection were determined in duplicate on CEF.

Replication kinetics: To compare the replication kinetics of sMVA and wtMVA, CEF or BHK-21 cells were seeded in 6 well-plate tissue culture format and at 70-90% confluency infected in triplicates at 0.02 MOI with sMVA or wtMVA using MEM2. After 2 hours of incubation, the cells were grown in MEM10. At 24 and 48 hours post infection, virus was prepared by freeze/thaw method and the virus titers of each triplicate infection and the inoculum was determined in duplicate on CEF.

Plaque size analysis: To compare the plaque size of sMVA virus and wtMVA, CEF or BHK-21 cells were seeded in 6-well plate tissue culture format and at 70-90% confluency infected with 0.002 MOI with sMVA or wtMVA using MEM2. After 2 hours of incubation, MEM10 was added and the cells were grown for 16-24 hours. The cell monolayers were stained with Vaccinia virus polyclonal antibody and viral plaques were imaged using Leica DMi8 inverted microscope and measured using LAS X software. The size of 25 viral plaques per sMVA or wtMVA was calculated using the formula Area=$\pi \times a \times b$, where a and b are the major and minor radius of the ellipse, respectively.

PCR analysis: To characterize the viral DNA of the sMVA vectors by PCR, CEF were seeded in 6-well plate tissue culture format and at 70-90% confluency infected at 5 MOI with sMVA or wtMVA. DNA was extracted at 16-24 hours post infection by the DNA Easy Blood and Tissue Kit (Qiagen) according to the manufacturer's instructions. All PCR reactions were performed with Phusion polymerase (ThermoFisher Scientific). Primers 5'-TCG TGG TGT GCC TGA ATC G-3' and 5'-AGG TAG CGA CTT CAG GTT TCT T-3' (SEQ ID NO: 74) were used to detect MVA ITR sequences; primers 5'-TAT CCA CCA ATC CGA GAC CA-3' and 5'-CCT CTG GAC CGC ATA ATC TG-3' (SEQ ID NO: 75) were used to verify the transition from the left ITR into the unique region; primers 5'-AGG TTT GAT CGT TGT CAT TTC TCC-3' and 5'-AGA GGG ATA TTA AGT CGA TAG CCG-3' (SEQ ID NO: 76) were used to verify the Del2 site with or without inserted N antigen sequence; primers 5'-TGG AAT GCG TTC CTT GTG C-3' (SEQ ID NO: 77) and 5'-CGT TTT TCC CAT TCG ATA CAG-3' (SEQ ID NO: 78) with binding sites flanking the F1/F2 homologous sequences were used to verify the F1/F2 recombination site; primers 5'-TAT AGT CTT TGT GGC ATC CGT TG-3' (SEQ ID NO: 79) and 5'-ACC CAA ACT TTA GTA AGG CCA TG-3' (SEQ ID NO: 80) were used to verify the IGR69/70 insertion site with or without inserted S antigen; primers 5'-ATA AGC GTT GTC AAA GCG GG-3' (SEQ ID NO: 81) and 5'-AGG AAA TAG AAA TTG TTG GTG CG-3' (SEQ ID NO: 82) with binding sites flanking the F2/F3 homologous sequences were used to verify the F2/F3 recombination site; primers 5'-ACA TTG GOG GAC AAT CTA AAA AC-3' (SEQ ID NO: 83) and 5'-ATC ATC GGT GGT TGA TTT AGT AGT G-3' (SEQ ID NO: 84) were used to verify the Del3 insertion site with and without inserted S or N antigen sequences; primers 5'-TAT CCA CCA ATC CGA GAC CA-3' (SEQ ID NO: 85) and 5'-GTC TGT CCG TCT TCT CTA TTG TTT A-3' (SEQ ID NO: 86) were used to verify the transition from the unique region into the right ITR; and primers 5'-TTA ACT CAG TTT CAA TAC GGT GCA G-3 (SEQ ID NO: 87) and 5'-TGG GGT TTC TTC TCA GGC TAT C-3' (SEQ ID NO: 88) were used to detect the SopA element of the BAC vector. PCR products were analyzed by agarose gel electrophoresis and imaged using Syngene PXi6 imager with GeneSys (v1.5.4.0) software. Uncropped gel images are provided as Source Data file. To sequence the PCR products derived from the sMVA vectors, the amplified PCR products were purified using the Nucleo-Spin Gel and PCR Clean-up Kit (Macherey-Nagel) according to the manufacturer's instructions and analyzed by Sanger sequencing.

Restriction pattern analysis: BHK-21 cells were seeded in 20×150 mm tissue culture dishes, grown to about 70-90% confluency, and infected at 0.01 MOI with wtMVA, sMVA tv1, or sMVA tv2. The purified virus was prepared two days post-infection as previously described[47]. Viral DNA (vDNA) was phenol/chloroform extracted, followed by ethanol precipitation as previously described[51]. Briefly, isolated virus particles were resuspended in lysis buffer (50 mM Tris-HCl PH 8.0, 1.2% SDS, 4 mM EDTA pH 8.0, 4 mM CaCl2, and 0.4 mg/mL proteinase K) and incubated overnight at 37° C. DNA was extracted twice with phenol; each extraction was performed by adding an equal volume of buffered phenol and centrifugation at room temperature (RT) for 10 min at 300×g. Aqueous phase was carefully collected to avoid DNA shearing. Final extraction was performed by adding equal volume of 1:1 phenol/chloroform to aqueous phase, followed by centrifugation as described above, and completed by ethanol precipitation of phenol/chloroform extracted viral DNA. DNA concentration and A260/A280 ratios were determined using Nano Vue (GE Healthcare Bio-sciences Corp). 10 μg of vDNA were digested with 3 units of either KpnI or XhoI, followed by visualization on 0.5% EtBr-stained agarose gel that was run at 2.4 v/cm, overnight. Images were acquired using Syngene PXi6 imager with GeneSys (v1.5.4.0) software.

Sequencing of sMVA fragments and sMVA vectors: PacBio (Pacific Biosciences) Long Read Sequencing analysis was used to determine the sequences of the cloned sMVA fragments (F1-F3) and reconstituted sMVA vectors. Plasmid DNA for sequencing the sMVA fragments was isolated by QIAGEN Large-Construct Kit according to the manufacturer's instructions. Viral DNA for sequencing sMVA was isolated from purified virus particles by phenol/chloroform extraction as disclosed above. Viral DNA for sequencing the sMVA-CoV2 vectors was isolated from purified virus particles by NucleoSpin Blood QuickPure DNA extraction kit (Macherey-Nagel) according the manufacturer's instructions. Briefly, 5 μg of fragmented DNA was converted to barcoded SMRTbell libraries using the SMRTbell Template Prep Kit 1.0 and Barcoded Adapter Plate-96 (PacBio). Libraries of the sMVA fragments and sMVA vector were size-selected (7-kb size cutoff) with BluePippin (Sage Science). After polymerase binding to the libraries with sequencing primers, the polymerase complexes were loaded into RSII SMRT cells using MagBeads loading and sequenced on PacBio RSII with 6 h movie. The polymerase complexes of sMVA-CoV2 vectors were loaded into a Sequel SMRT cell using diffusion mode and sequenced on PacBio Sequel with 10 h movie. Read demultiplexing, read mapping to the reference sequences, and Circular Consensus Sequencing (CCS) analyses were performed by Demultiplex Barcodes, Resequencing, and CCS modules, respectively, either in SMRT Portal (v. 2.3.0) or SMRT Link (v6.0.0.47841) or SMRT Link (v8.0.0.80529). The variants calling with CCS reads were carried out using VarScan v2.3.9 after mapping CCS reads using pbmm2v 1.0.0. De novo assembly was done using canu v1.7.1. The 5' start position of the assembled contig was edited by comparing to the references. MVA U94848.1 was used as a reference for mapping the reads of the sMVA genome sequence. Sequences of the sMVA fragments and sMVA-CoV2 vectors were mapped via alignment with corresponding reference sequences based on MVA U94848.1 that were constructed by Vector NTI (Invitrogen, v. 11.5). Along with the comparison of de novo assembled contig to each reference, this analysis confirmed the sequence identity of the cloned sMVA fragments and reconstituted sMVA vectors, including a single point mutation in a non-coding determining region at 3 base pairs downstream of 021L4 that was found in sMVA fragment F1 and all sequenced reconstituted sMVA vectors (sMVA and sMVA-CoV-2 vectors). An additional variation (point mutation) that could not be unambiguously excluded was found in a non-coding determining region at the tandem repeats 88 bp from the end of the ITR within sMVA fragment F3. As these two variations were present in the cloned sMVA fragments, they were confirmed as errors originating during the chemical synthesis of the sMVA fragments. The internal unique region and unique regions of the ITRs encompassing the complete MVA coding content could be reliably assembled for all reconstituted sMVA vectors. The sequence contig of the sMVA vector covered almost (over 99%) the complete U94848.1 reference sequence, with only a few exceptions at the highly repetitive ITR tandem repeats. The complete regions of the ITR tandem repeats of the sMVA-CoV2 vectors could not be reliably mapped through alignment with the reference sequences or de novo assembly due to low coverage at these regions, likely as a result of the quality of the sequence reads. Reference sequences of the sMVA fragments and sMVA-CoV2 vectors based on the PacBio sequencing were deposited in NCBI. To determine the absence of contaminating BAC vector sequences in the raw sequencing data of the reconstituted sMVA vectors, the sequencing reads were aligned onto the reference pCCI-Brick vector sequence provided by Genscript using the resequencing module in SMRT Link (v8.0.0.80529).

Immunoblot analysis: BHK-21 cells infected at 5 MOI were harvested 24-hours post infection. Proteins were solubilized in PBS with 0.1% Triton X-100, supplemented with protease inhibitor, then reduced and denatured in Laemmli buffer containing DTT and boiled at 95° C. for about 10 minutes. Proteins were resolved on a 4-20% Mini Protean TGX gradient gel (BioRad), and transferred onto PVDF membrane. S protein was probed with anti-SARS-CoV-1 S1 subunit rabbit polyclonal antibody (40150-T62-CoV2, Sino Biological); N protein was probed with anti-SARS-CoV1 NP rabbit polyclonal antibody (40413-T62, Sino Biological). Vaccinia BR5 protein was probed as a loading control. Anti-rabbit polyclonal antibody conjugated with horseradish peroxidase (Sigma-Aldrich) was used as a secondary antibody and protein bands were visualized with chemiluminescent substrate (ThermoFisher).

Flow cytometry: Hela cells were seeded in a 6-well plate (5×10$^5$/well) and infected the following day with sMVA vaccine candidates at an MOI of 5. Following an incubation of 6 hours, cells were detached with non-enzymatic cell dissociation buffer (Cat. No. 13151014, GIBCO). Cells were either incubated directly with primary antibody or fixed and permeabilized prior to antibody addition. Anti-SARS-CoV-1 S1 mouse (40150-R007, Sino Biological) and S2 rabbit (GTX632604, GeneTex) monoclonal antibodies, anti-SARS-CoV-1 N rabbit monoclonal antibody (40143-R001, Sino Biological), and anti-vaccinia rabbit polyclonal antibody (9503-2057, Bio Rad) were used in dilution 1:2,000. One hour later anti-mouse or anti-rabbit Alexa Fluor 488-conjugated secondary antibodies (A11001, A21206; Invitrogen) were added to the cells at a dilution of 1:4,000. Live cells were ultimately fixed with 1% paraformaldehyde (PFA) and acquired using a BD FACSCelesta flow cytometer with BD FACSDiva software (v8.0.1.1). Analysis was performed using FlowJo (v10.6.2).

Immunofluorescence: BHK-21 or Hela cells were grown on glass coverslips and infected with sMVA or recombinant sMVAs encoding S and/or N proteins at an MOI of 5 for 6 hours at 37° C. in a humidified incubator (5% CO$_2$). After infection, cells were fixed for 15 minutes in 2% PFA and then directly permeabilized by addition of ice cold 1:1 acetone/methanol for 5 minutes on ice. Cells were blocked for 1 hour with 3% BSA at room temperature, incubated with primary antibody mix (1:500) against the S2 subunit or N for 1 hour at 37° C., and then incubated with Alexa-conjugated secondary antibodies (ThermoFisher) (1:2000) for 1 hour at 37° C., with washing (PBS+0.1% Tween20) between each step. For detection of cell membranes and nuclei, cells were incubated with Alexa-conjugated wheat germ agglutinin at 5 μg/mL (ThermoFisher) and DAPI for 10 minutes at room temperature. Coverslips were washed and mounted onto slides with Fluoromount-G (SouthernBiotech). Microscopic analysis was performed using a laser-scanning confocal microscope (Zeiss, LSM700). Images were acquired and processed using Zen software (Zeiss, Black Edition Version 8.1).

Mouse immunization: The Institutional Animal Care and Use Committee (IACUC) of the Beckman Research Institute of City of Hope (COH) approved protocol 20013 assigned for this study. All study procedures were carried out in strict accordance with the recommendations in the Guide for the Care and Use of Laboratory Animals and the Public Health Service Policy on the Humane Care and Use of Laboratory Animals. 6 weeks old C57BL/6 (C57BL/6J, 000664) or Balb/c (BALB/cJ, 000651) were purchased from the Jackson laboratories. C57BL/6 Nramp were bred at the City of Hope animal facility. Mice (N=4-5) were immunized twice in three-week intervals by intraperitoneal route with $5\times10^7$ PFU (high dose) or $1\times10^7$ PFU (low dose) of sMVA, wtMVA, or sMVA-CoV2 vectors. To determine immune stimulation by both the S and N antigen when using separate vectors (FIGS. 15-16), mice were co-immunized via the same immunization schedule and route with half of the high $(2.5\times10^7$ PFU) or low dose $(0.5\times10^7$ PFU) of each of the vaccine vectors. Blood samples for humoral immune analysis were collected by retro-orbital bleeding two weeks post-prime and one-week post booster immunization. Splenocytes for cellular immune analysis were collected at one-week post booster immunization and were isolated by standard procedure after animals were humanely euthanized.

Binding antibodies: Binding antibodies in mice immunized with sMVA, wtMVA, or sMVA-CoV2 vectors were evaluated by ELISA. ELISA plates (3361, Corning) were coated overnight with 1 µg/ml of MVA expressing Venus fluorescent marker[9], S (S1+S2, 40589-V08B1, Sino Biological), RBD (40592-V08H, Sino Biological) or N (40588-V08B, Sino Biological). Plates were blocked with 3% BSA in PBS for 2 hours. Serial dilutions of the mouse sera were prepared in PBS and added to the plates for two hours. After washing, 1:3,000 dilution of HRP-conjugated anti-mouse IgG secondary antibody (W402B, Promega) was added and incubated for one additional hour. Plates were developed using 1-Step Ultra TMB-ELISA (34028, Thermo Scientific) for one to two minutes after which the reaction was stopped with 1M H2SO4. Plates were read at 450 nm wave length using FilterMax F3 microplate reader (Molecular Devices). Binding antibody endpoint titers were calculated as the last serum dilution to have an absorbance higher than 0.1 absorbance units (OD) or higher than the average OD in mock immunized mice plus 5 times the standard deviation of the OD in the same group at the same dilution. For evaluation of the IgG2a/IgG1 ratio, mouse sera were diluted 1:10,000 in PBS. The assay was performed as described above except for the secondary antibodies (1:2,000. goat Anti-Mouse IgG2a cross absorbed HRP antibody, Southern biotech, 1083-05; Goat anti-Mouse IgG1 cross absorbed HRP antibody, Thermo Scientific, A10551). The IgG2a/IgG1 ratio was calculated by dividing the absorbance read in the well incubated with the IgG2a secondary antibody divided by the absorbance for the same sample incubated with the IgG1 antibody.

MVA neutralization assay: ARPE-19 cells were seeded in 96 well plates ($1.5\times10^4$ cells/well). The following day, serial dilutions of mouse sera were incubated for 2 hours with MVA expressing the fluorescent marker Venus10 ($1.5\times10^4$ PFU/well). The serum-virus mixture was added to the cells in duplicate wells and incubated for 24 hours. After the 24-hour incubation period, the cells were imaged using a Leica DMi8 inverted microscope. Pictures from each well were processed using Image-Pro Premier (Media Cybernetics) and the fluorescent area corresponding to the area covered by MVA-Venus infected cells was calculated.

SARS-CoV-2 pseudovirus production: The day before transfection, HEK293T/17 were seeded in a 15 cm dish at a density of $5\times10^6$ cells in DMEM supplemented with 10% heat inactivated FBS, non-essential amino acids, HEPES, and glutamine[52]. Next day, cells were transfected with a mix of packaging vector (pALDI-Lenti System, Aldevron), luciferase reporter vector and a plasmid encoding for the wild type SARS-CoV2 Spike protein (Sino Biological) or vesicular stomatitis virus G (VSV-G, Aldevron), using FuGENE6 (Roche) as a transfection reagent:DNA ratio of 3:1, according to manufacturer's protocol. Sixteen hours post-transfection, the media was replaced and cells were incubated for an additional 24-72 hours. Media were harvested at 24-, 48- and 72 hours, clarified by centrifugation at 1,500 RPM for 5 minutes and filtered using a sterile 0.22 µm pore size filter. Clarified lentiviral particles were concentrated by ultracentrifugation at 20,000 RPM for 2 hours at 4° C. The pellet was resuspended in DMEM containing 2% heat inactivated-FBS and stored overnight at 4° C. to allow the pellet to completely dissolve. Next day, samples were aliquoted, snap frozen and stored at −80° C. for downstream assays.

SARS-CoV-2 pseudotype neutralization and ADE assay: Levels of p24 antigen in the purified SARS-CoV-2 pseudotype suspension were measured by ELISA (Takara). Mouse sera were heat inactivated, pooled and diluted at a linear range of 1:100 to 1:50,000 in complete DMEM. For the neutralization assay, diluted serum samples were pre-incubated overnight at 4° C. with SARS-CoV-2-Spike pseudotyped luciferase lentiviral vector, normalized to 100 ng/ml of p24 antigen. HEK293T cells overexpressing ACE-2 receptor were seeded the day before transduction at a density of $2\times10^5$ cells per well in a 96-well plate in complete DMEM. Before infection, 5 µg/mL of polybrene was added to each well. Neutralized serum samples were then added to the wells and the cells were incubated for an additional 48 hours at 37° C. and 5% $CO_2$ atmosphere. Following incubation, cells were lysed using 40 µL of Luciferase Cell Culture Lysis 5× Reagent per well (Promega). Luciferase activity was quantified using 100 µL of Luciferase Assay Reagent (Promega) as a substrate. Relative luciferase units (RLU) were measured using a microplate reader (SpectraMax L, Molecular Devices) at a 570 nm wave length. The percent neutralization titer for each dilution was calculated as follows: NT=[1−(mean luminescence with immune sera/mean luminescence without immune sera)]×100. The titers that gave 90% neutralization (NT90) were calculated by determining the linear slope of the graph plotting NT versus serum dilution by using the next higher and lower NT. In all the experiments RLU in uninfected cells was measured and was always between 50 and 90.

For the ADE assay, THP1 cells were seeded at a confluency of $2\times10^6$ cells/mL in a 96 well plate and co-incubated for 48 hours with serum samples diluted at 1:5,000 or 1:50,000 in the presence of SARS-CoV-2-Spike pseudotyped or VSV-G luciferase lentiviral vector, normalized to 100 ng/ml of p24 antigen. Following incubation, cells were lysed using 100 µL of ONE-Glo Luciferase Assay System per well (Promega). RLU were measured as above.

SARS-CoV-2 focus reduction neutralization test (FRNT): HeLa-ACE2 cells were seeded in 12 µL complete DMEM at a density of $2\times10^3$ cells per well. In a dilution plate, pooled mouse serum was diluted in series with a final volume of 12.5 μL. Then 12.5 μL of SARS-CoV-2 virus was added to the dilution plate at a concentration of $1.2 \times 10^4$ pfu/mL.

After 1 hour incubation, the media remaining on the 384-well plate was removed and 25 μL of the virus/serum mixture was added to the 384-well plate. The plate was incubated for 20 hours after which the plate was fixed for 1 hour. Each well was then washed three times with 100 μL of 1×PBS 0.05% tween. 12.5 μL of human polyclonal sera diluted 1:500 in Perm/Wash buffer (BD Biosciences 554723) were added to each well in the plate and incubated at room temperature (RT) for 2 hours. The plate was washed three times and peroxidase goat anti-human Fab (Jackson Scientific) was diluted 1:200 in Perm/Wash buffer then added to the plate and incubated at RT for 2 hours. The plate was then washed three times and 12.5 μL of Perm/Wash buffer was added to the plate then incubated at RT for 5 minutes. The Perm/Wash buffer was removed and TrueBlue peroxidase substrate was immediately added (Sera Care 5510-0030). Sera were tested in triplicate wells. Normal human plasma was used as negative controls for serum screening.

SARS-CoV-2 convalescent plasma samples: COH Institutional Biosafety Committee Protocol 20004 approved the use of SARS-CoV-2 convalescent plasma. Anonymized plasma samples of SARS-CoV-2 convalescent individuals (N=19) were obtained from the University of California, San Diego. Individuals were confirmed to be infected in the previous three to ten weeks by PCR and lateral flow assay. All individuals were symptomatic with mild to moderate-severe symptoms. Serum samples (DS-626-G and DS-626-N, Seracare) purchased before SARS-CoV-2 pandemic were used as a negative control. SARS-CoV-2-specific binding antibodies in plasma samples were measured as described above. Cross-adsorbed goat anti-human IgG (H+L) secondary antibody (A18811, Invitrogen) was used at a dilution of 1:3,000.

T cell analysis: Spleens were harvested and dissociated using a cell mesh following which blood cells were removed using RBC Lysis Buffer (BioLegend). $2.5 \times 10^6$ splenocytes were stimulated with S or N peptide libraries (GenScript, 15mers with 11 aa overlap, 1 μg/ml), 0.1% DMSO, or phorbol myristate acetate (PMA)-ionomycin (BD Biosciences) for 1.5 hours at 37° C. Anti-mouse CD28 and CD49d antibodies (1 μg/ml; BioLegend) were added as co-stimulation. Brefeldin A (3 μg/ml; eBioscience) was added, and the cells were incubated for additional 16 hours at 37° C. Cells were fixed using Cytofix buffer (BD Biosciences) and surface staining was performed using fluorescein isothiocyanate (FITC)-conjugated anti-mouse CD3 (Clone 17A2, 555274, BD), BV650 anti-mouse CD8a (Clone 53-6.7, 563234, BD). Following cell permeabilization using Cytoperm buffer (BD Biosciences), ICS was performed using allophycocyanin (APC)-conjugated anti-mouse IFN-γ (Clone XMG1.2, 554413, BD), phycoerythrin (PE)-conjugated anti-mouse TNF-α (Clone MP6-XT22, 554419, BD), and PE-CF594 anti-mouse IL-2 (BD Biosciences (Clone JES6-5H4, 562483, BD). In experiments testing double recombinants SARS-CoV2 vectors IL-2 antibody was not included and PE-CF594 anti-mouse IL-4 (clone 11B11, 562450, BD) and BV421 rat anti mouse IL-10 (clone JES5-16E3, 563276, BD) were added. Events were acquired using a BD FACSCelesta flow cytometer ($2 \times 10^5$ cells/tube). Analysis was performed using FlowJo. Antigen specific T cells were identified by gating on size (FSC vs SSC), doublet negative (FSC-H vs FSC-A), CD3+, CD8+/CD4+. Cytokine positive responses are presented after subtraction of the background response detected in the corresponding unstimulated sample (media added with Brefeldin A one hour after beginning of mock stimulation) of each individual mouse sample. Polyfunctional T-cells analysis was performed by applying FlowJo Boolean combination gating.

Cytokine ELISA: Splenocytes ($1 \times 10^6$) from immunized mice were incubated in v-bottom wells in the presence of 2 μg/ml S or N peptide pools, or without stimulus in a volume of 200 μl. 48 hours later, plates were centrifuged 2000 RPM for 10 minutes and cell supernatant was collected and stored at −80° C. Mouse TNF-alpha (MTA00B), Quantikine ELISA kit (R&D systems) was used according to manufacturer's recommendations.

IFNγ ELISpot: T-cell detection by IFNγ ELISpot assay was performed according to the manufacturer's instructions (3321-2A, Mabtech). ELISpot PVDF plates (MSIPS4W10, Millipore) were pre-activated with ethanol and coated with IFNγ-coating antibody. Splenocytes ($2 \times 10^5$ peptide-stimulated, $2 \times 10^4$ PMA/Ionomycin-stimulated) were added to duplicate wells and incubated overnight with 2 μg/mL peptides. Stimuli included S and N peptide libraries; S1 subunit peptide pools covering peptides 1-86 (pool 1S1) and 87-168 (pool 2S1) of the S library; S2 subunit peptide pool that included peptides 169-316 of the S library; and peptide N26

(MKDLSPRWYFYYLGT, SEQ ID NO: 89)

of the N peptide library. After 24 hours, cells were removed, and IFNγ-detection antibody followed by streptavidin-ALP were added. Spots were developed using BCIP/NBT-plus (3650-10, Mabtech) and analyzed using AID ELISpot reader with AID ELISpot 5.0 iSpot software.

Statistics: Statistical evaluation was pursued using Graph-Pad Prism (v8.3.0). For evaluation of differences in sMVA and wtMVA plaque area in BHK-21 and CEF cells and differences in sMVA and wtMVA host cell range, one-way ANOVA followed by Tukey's and Dunnet's multiple comparison tests were used, respectively. For sMVA and wtMVA growth kinetic analysis, mixed-effects model with the Geisser-Greenhouse correction, followed by Tukey's multiple comparisons test were applied. For ELISAs, one-way ANOVA and Tukey's multiple comparison tests were used to calculate differences in endpoint titers and group means between groups. For IgG2a/IgG1 ratio analysis, one-way ANOVA with Dunnett's multiple comparison test was used to compare the IgG2a/IgG1 ratio measured in each group to a ratio of 1. Pearson correlation analysis was performed to calculate the correlation coefficient r and its significance. For T cell response analysis, one-way ANOVA followed by Dunnett's multiple comparisons test with a single pooled variance was used to compare the mean of each group. For ELISpot analysis, two-way ANOVA with Dunnett's multiple comparison test was applied.

Example 1: Construction of sMVA

To develop the three-plasmid system of the sMVA vaccine platform, three unique synthetic sub-genomic MVA fragments (sMVA F1-F3) were designed based on the MVA genome sequence published by Antoine et al.[4], which is about 178 kbp in length and contains about 9.6 kbp inverted terminal repeats (ITRs) (FIG. 1A). The three fragments were designed as follows: sMVA F1 comprises about 60 kbp of the left part of the MVA genome, including the left ITR sequences; sMVA F2 contains about 60 kbp of the central part of the MVA genome; and sMVA F3 contains about 60 kbp of the right part of the MVA genome, including the right ITR sequences (FIG. 1B). sMVA F1 and F2 as well as sMVA F2 and F3 were designed to share about 3 kb overlapping homologous sequences to promote recombination of the three sMVA fragments (FIG. 1B). In addition, a duplex copy of the 165-nucleotide long MVA terminal hairpin loop (HL) flanked by concatemeric resolution (CR) sequences was added to both ends of each of the three sMVA fragments (FIG. 1C). Such CR/HL/CR sequence arrangements are formed at the genomic junctions in poxvirus DNA replication intermediates and essential for genome resolution and packaging[27-31]. When circular DNA plasmids containing these CR/HL/CR sequence arrangements are transfected into helper virus-infected cells they spontaneously resolve into linear minichromosomes with intact terminal HL sequences[28,29,32]. The three sMVA fragments designed as shown in FIGS. 1B-1C, when co-transfected as circular DNA plasmids into helper virus infected cells, can resolve into linear minichromosomes, recombine with each other via the shared homologous sequences, and are ultimately packaged as full-length MVA genomes. All three sMVA fragments were cloned in *E. coli* as bacterial artificial chromosome (BAC) clones.

Using a previously employed procedure to rescue MVA from a BAC[8,9,33], sMVA virus was reconstituted with Fowl pox (FPV) as a helper virus upon co-transfection of the three DNA plasmids into BHK-21 cells (FIG. 1D), which are non-permissive for FPV[34]. Two different FPV strains (HP1.441 and TROVAC)[35,36] were used to promote sMVA virus reconstitution (FIG. 2A). The purified sMVA virus was produced following virus propagation in CEF, which are commonly used for MVA vaccine production. The virus titers achieved with reconstituted sMVA virus were similar to virus titers achieved with "wild-type" MVA (wtMVA) (Table 1).

TABLE 1

| Construct | Insert (insertion site) | Titer* |
|---|---|---|
| sMVA hp | None | $6.8 \times 10^9$ PFU/ml |
| sMVA tv1 | None | $4.1 \times 10^9$ PFU/ml |
| sMVA tv2 | None | $2.3 \times 10^9$ PFU/ml |
| wtMVA | None | $4.1 \times 10^9$ PFU/ml |
| sMVA-S tv | Spike (Del3) | $4.3 \times 10^9$ PFU/ml |
| sMVA-N tv | Nucleocapsid (Del3) | $1.0 \times 10^{10}$ PFU/ml |
| sMVA-S/N hp | Spike (G1L), Nucleocapsid (Del3) | $8.8 \times 10^9$ PFU/ml |
| sMVA-N/S hp | Nucleocapsid (Del2), Spike (Del3) | $2.3 \times 10^9$ PFU/ml |
| sMVA-S/N tv | Spike (G1L), Nucleocapsid (Del3) | $8.8 \times 10^9$ PFU/ml |
| sMVA-N/S tv | Nucleocapsid (Del2), Spike (Del3) | $8.4 \times 10^9$ PFU/ml |

Figure 1F:
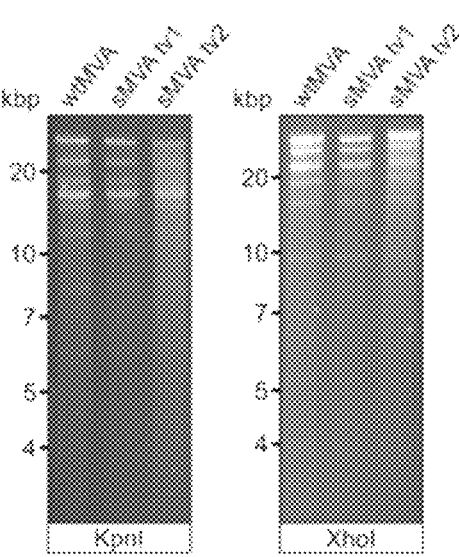

*Stocks were produced on CEF following infection (MOI 0.02) of 30 × 15 cm dishes Example 2: In Vitro Characterization of sMVA To characterize the viral DNA of sMVA, DNA extracts from sMVA and wtMVA-infected CEF were compared for several MVA genome positions by PCR.[15] Similar PCR results were obtained with sMVA and wtMVA for all evaluated genome positions (FIG. 1E), including the F1/F2 and F2/F3 recombination sites, indicating efficient recombination of the three sMVA fragments. Additional PCR analysis indicated the absence of any BAC vector sequences in sMVA viral DNA (FIG. 1E), suggesting spontaneous and efficient removal of the bacterial vector elements upon sMVA virus reconstitution. Comparison of viral DNA from purified sMVA and wtMVA virus by restriction enzyme digestion revealed similar genome pattern between sMVA and wtMVA (FIG. 1F). Sequencing analysis of the sMVA viral DNA confirmed the MVA genome sequence at several positions, including the F1/F2 and F2/F3 recombination sites. Furthermore, whole genome sequencing of one of the sMVA virus isolates reconstituted with FPV TROVAC confirmed the assembly of the reference MVA genome sequence and absence of vector-specific sequences in viral DNA originating from the reconstituted sMVA virus.

Figure 2C:
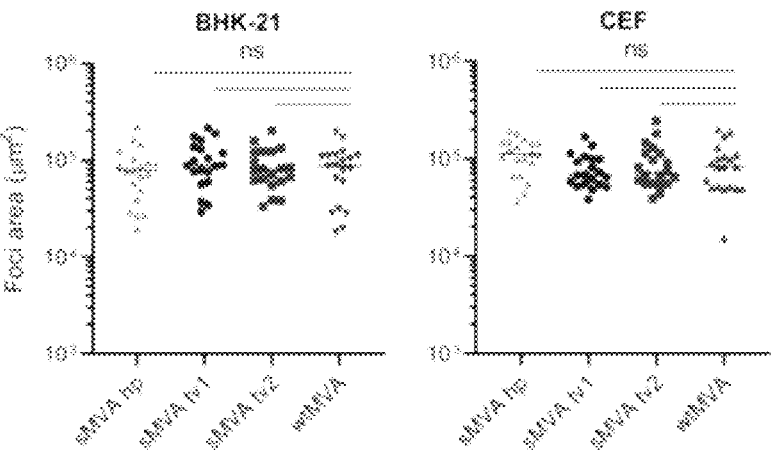
Figure 2D:
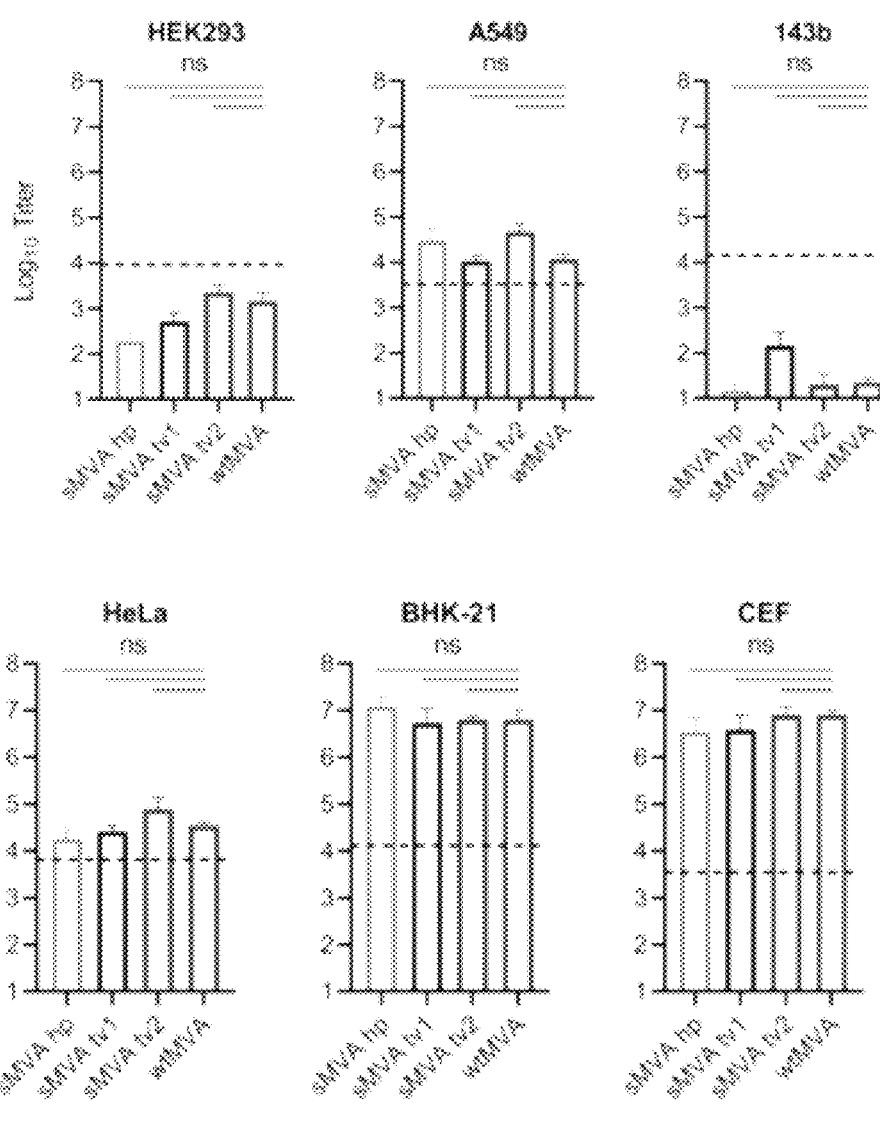

To characterize the replication properties of sMVA, growth kinetics of sMVA and wtMVA were compared on BHK-21 and CEF cells, two cell types known to support productive MVA replication[6]. This analysis revealed similar growth kinetics of sMVA and wtMVA on both BHK-21 and CEF cells (FIG. 2B). In addition, similar areas of viral foci were determined in BHK-21 and CEF cell monolayers infected with sMVA or wtMVA (FIG. 2C), suggesting similar capacity of sMVA and wtMVA to spread in MVA permissive cells. Compared to the productive replication of sMVA and wtMVA in BHK-21 and CEF cells[6], only limited virus production was observed with sMVA or wtMVA following infection of various human cell lines (FIG. 2D). These results are consistent with the severely restricted replication properties of MVA and show that the sMVA virus can efficiently propagate in BHK-21 and CEF cells, while it is unable to efficiently propagate in human cells.

Example 3: In Vivo Immunogenicity of sMVA

Figure 4A:
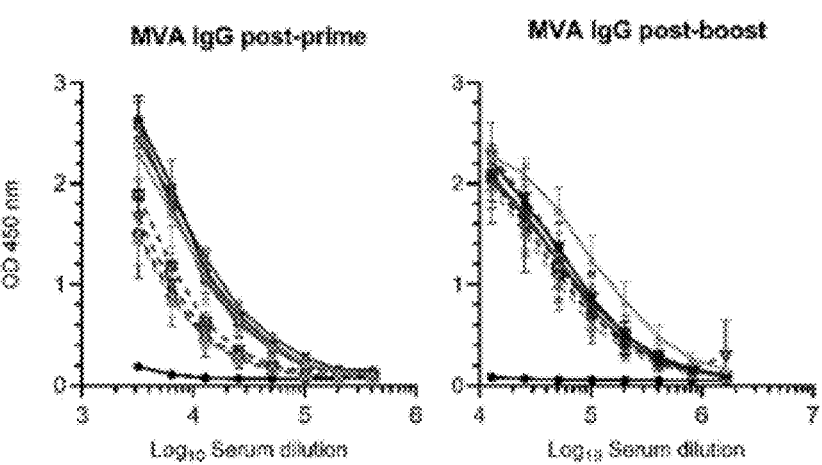
Figure 4B:
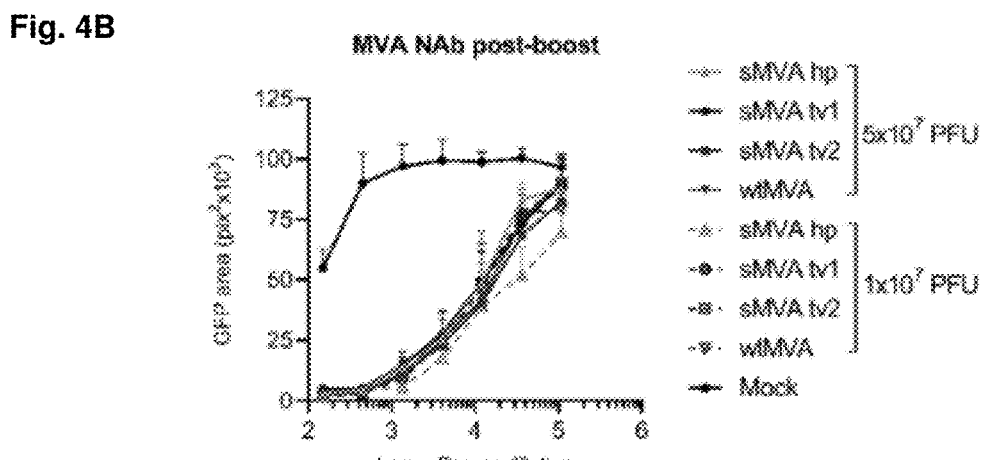
Figure 4C:
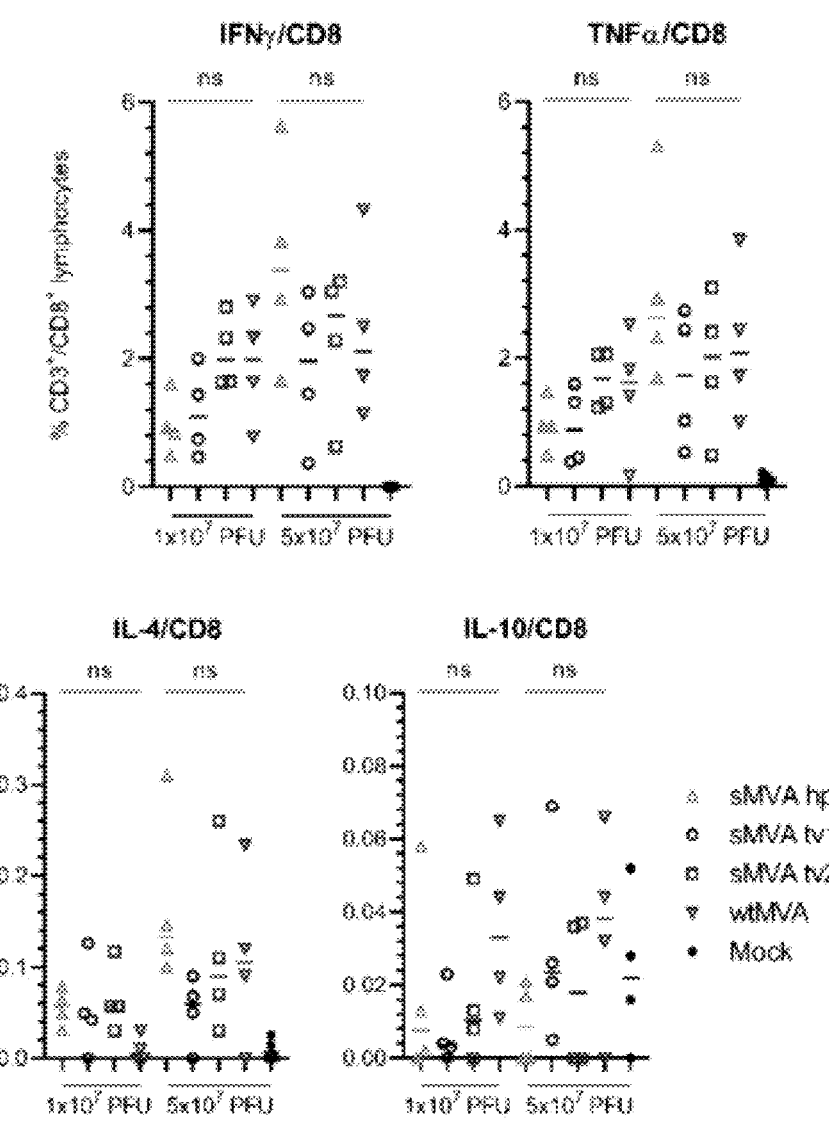

To characterize sMVA in vivo, the immunogenicity of sMVA and wtMVA was compared in C57BL/6 mice following two immunizations at high or low dose. MVA-specific binding antibodies stimulated by sMVA and wtMVA after the first and second immunization were comparable (FIGS. 3A, 4A). While the antibody levels in the high dose vaccine groups exceeded those of the low dose vaccine groups after the first immunization, similar antibody levels in the high and low dose vaccine groups were observed after the second immunization. In addition, no significant differences were detected in the levels of MVA-specific NAb responses induced by sMVA and wtMVA after the second immunization (FIGS. 3B, 4B). MVA-specific T cell responses determined after the booster immunization by ex vivo antigen stimulation using immunodominant peptides[35] revealed similar MVA-specific T cell levels in mice receiving sMVA or wtMVA (FIGS. 3C-3D and 4C-4D). These results indicate that the sMVA virus has a similar capacity as wtMVA in inducing MVA-specific humoral and cellular immunity in mice.

Example 4: Construction of sMVA SARS-CoV-2 Vaccine Vectors

Figure 5A:
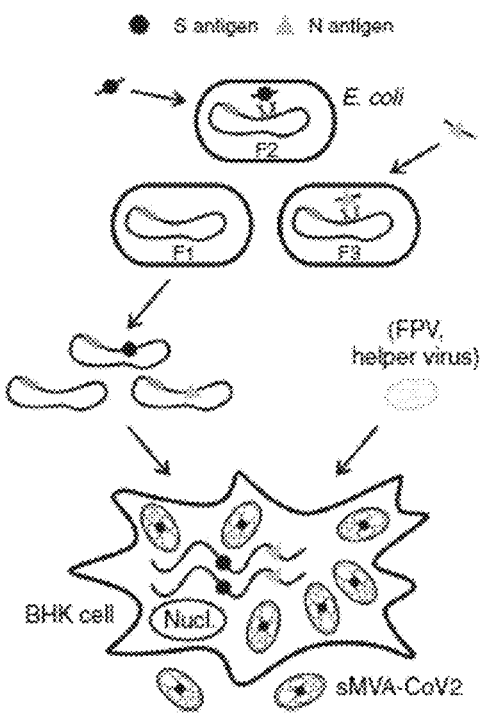
FIGS. 5A-5E show construction and characterization of sMVA-CoV2 vectors.
Figures 5B, 5C:
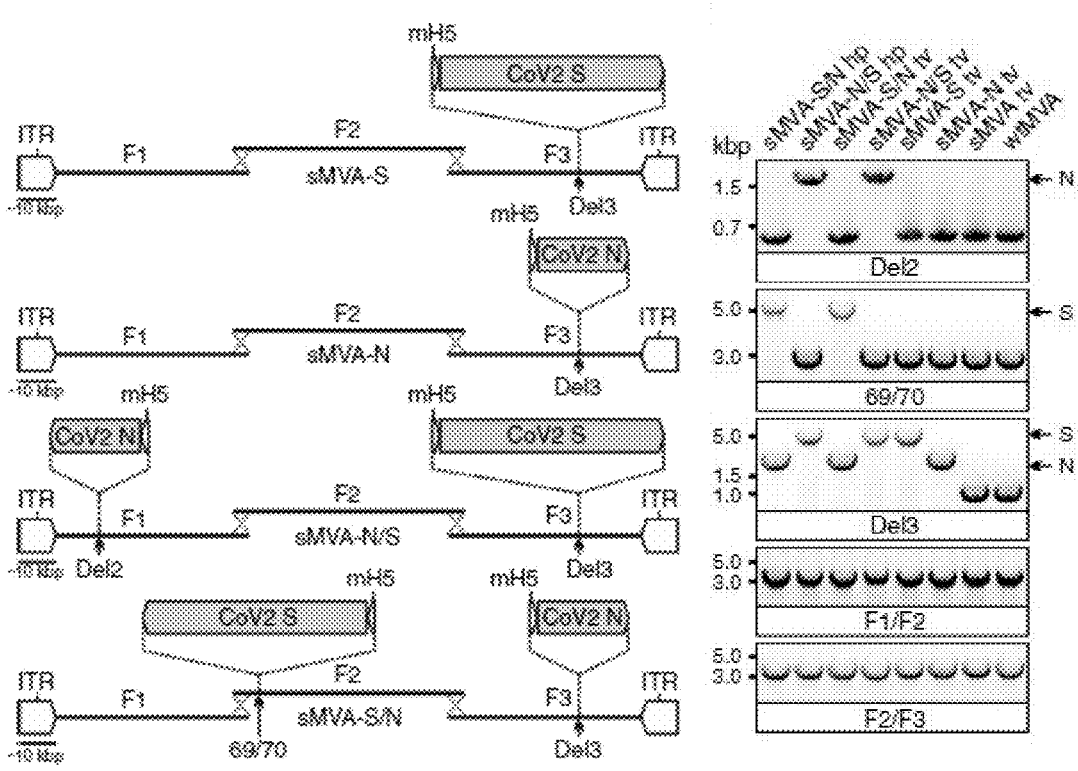

Using highly efficient BAC recombination techniques in *E. coli*, full-length SARS-CoV-2 S and N antigen sequences were inserted into commonly used MVA insertions sites located at different positions within the three sMVA fragments. Combinations of modified and unmodified sMVA fragments were subsequently co-transfected into FPV-infected BHK-21 cells to reconstitute sMVA SARS-CoV-2 (sMVA-CoV2) vectors expressing the S and N antigen sequences alone or combined (FIGS. 5A and 5B). In the single recombinant vectors encoding S or N alone, termed sMVA-S and sMVA-N, respectively, the antigen sequences were inserted into the Deletion (Del3) site (FIGS. 1B and 5B) 5. In the double recombinant vectors encoding both S and N, termed sMVA-N/S and sMVA-S/N, the antigen sequences were inserted into Del3 and the Deletion 2 (Del2)

site (sMVA-N/S), or they were inserted into Del3 and the intergenic region between 069R and 070L (IGR69/70) (sMVA-S/N) (FIGS. 1B and 5B)[5,38]. All antigen sequences were inserted into the sMVA-CoV2 vectors together with mH5 promoter to promote antigen expression during early and late phase of MVA replication[39,40]. sMVA-CoV-2 vaccine vectors were reconstituted with FPV strain HP1.441 or TROVAC. The purified virus of the sMVA-CoV2 vectors produced using CEF reached titers that were similar to those achieved with sMVA or wtMVA (Table 1). PCR and sequencing analysis of the Del2, Del3, and IGR69/70 MVA insertion sites confirmed the integrity and insertion of the SARS-CoV-2 antigen sequences in all sMVA-CoV2 vaccine vectors (FIG. 5C). Moreover, whole-genome sequencing of all double-recombinant sMVA-CoV2 vaccine vectors—reconstituted either with FPV strain TROVAC or HP1.441—verified the reference sequences of these vaccine constructs deposited in NCBI and confirmed the SARS-CoV-2 antigen sequences at the insertion sites, the identity of the MVA genome, and removal of the BAC vector sequences.

Example 5: In Vitro Characterization of sMVA-CoV2 Vaccine Vectors

Figure 5D:
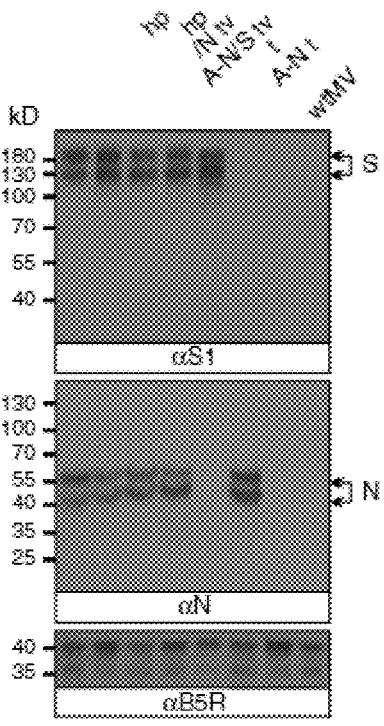

To characterize S and N antigen expression by the sMVA-CoV2 vectors, BHK-21 cells infected with the sMVA-CoV2 vectors were evaluated by Immunoblot using S and N-specific antibodies. This analysis confirmed the expression of the S or N antigen alone by the single recombinant vaccine vectors sMVA-S and sMVA-N, while the expression of both the S and the N antigen was confirmed for the double recombinant vectors sMVA-N/S and sMVA-S/N (FIG. 5D).

Figure 5E:
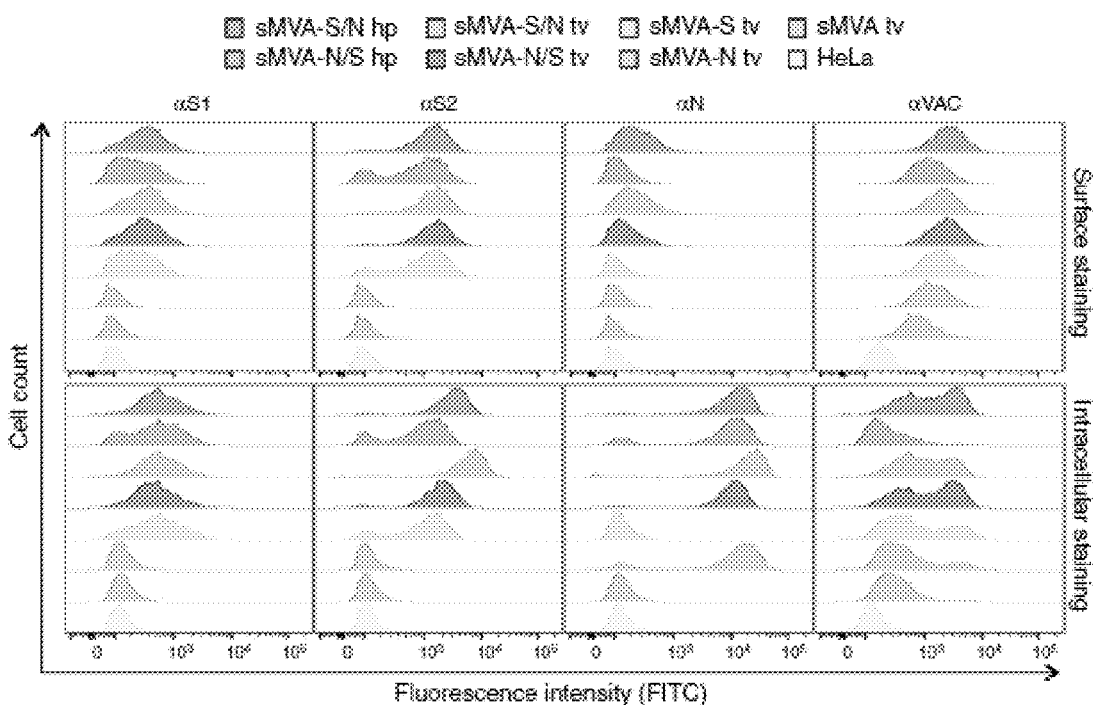
Figure 6A:
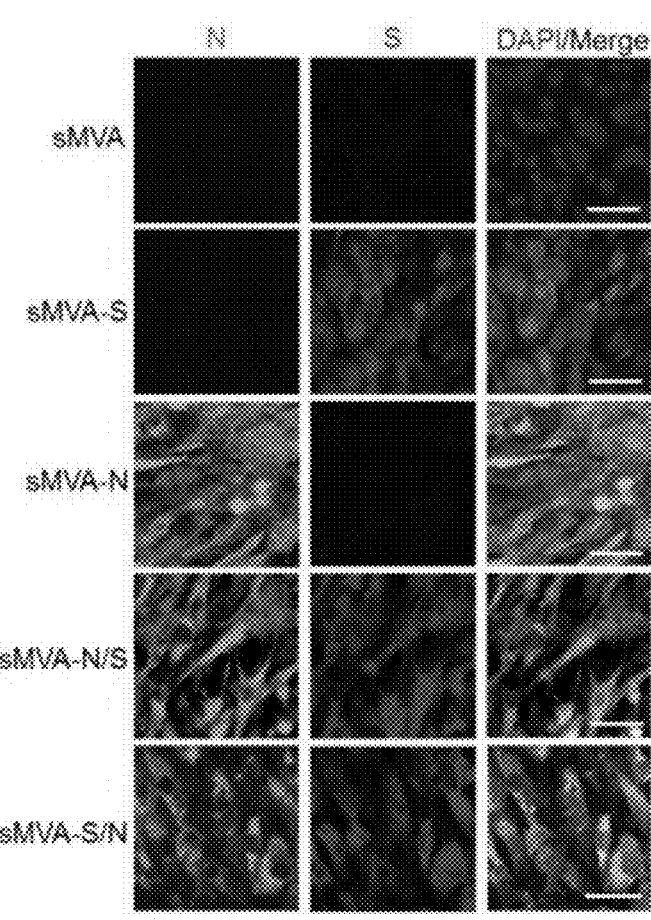
FIGS. 6A-6D show in vitro characterization of sMVA-CoV2 vectors.
Figure 6B:
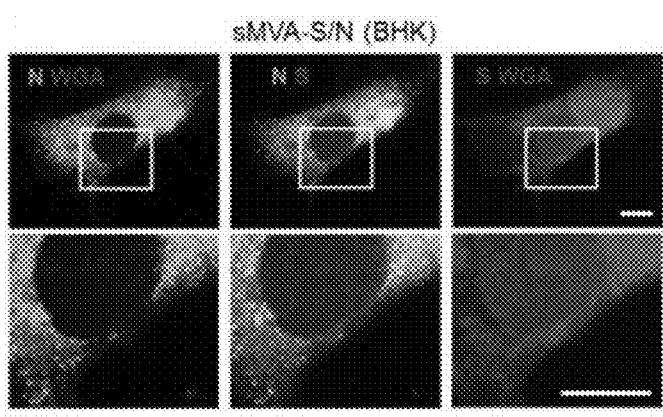
Figure 6C:
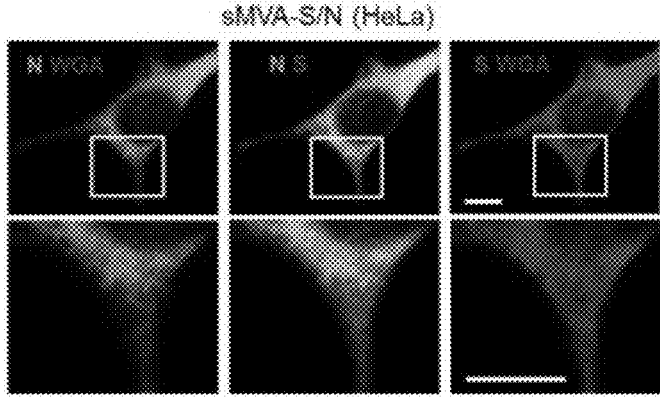
Figure 6D:
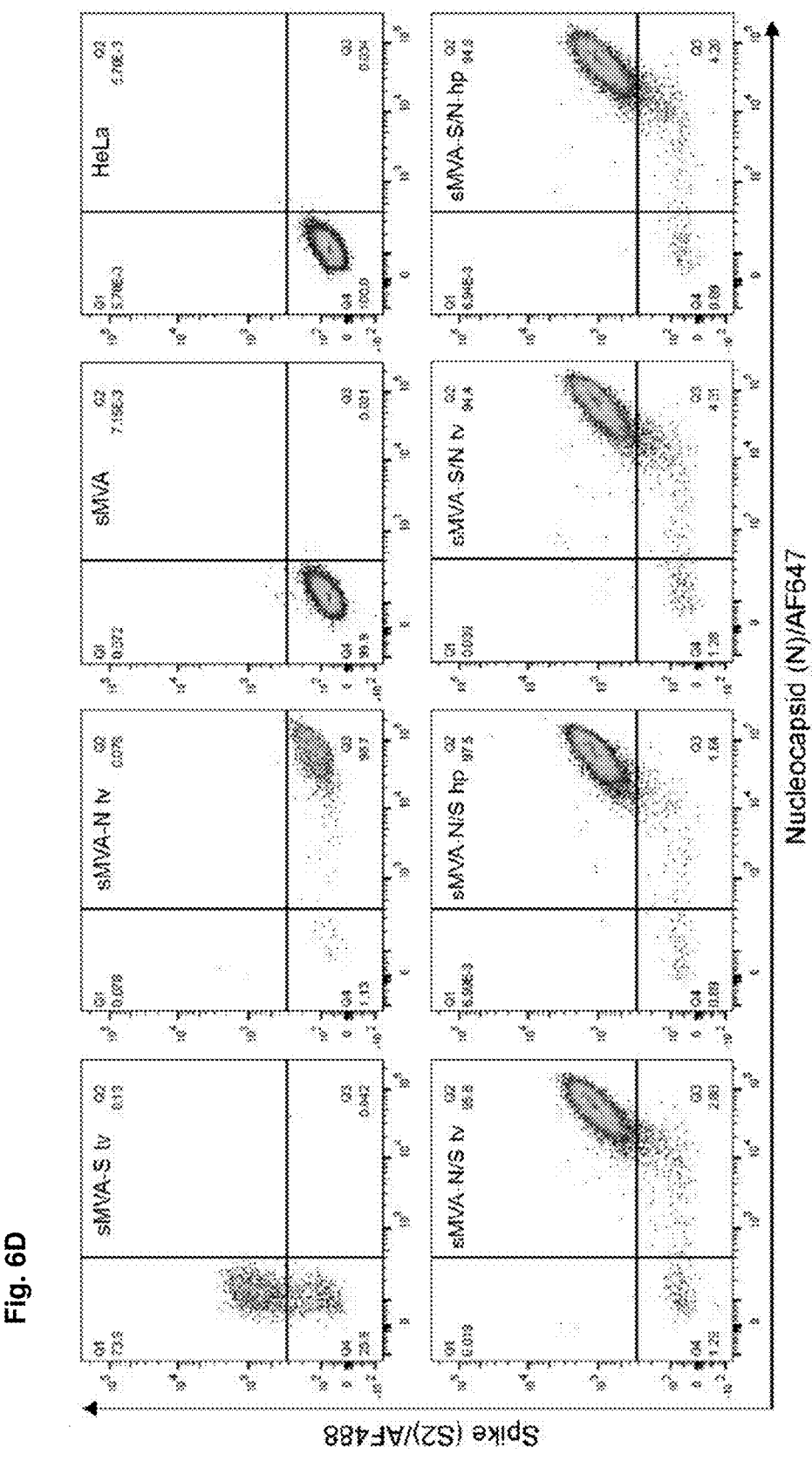

Further characterization of the antigen expression by the sMVA-CoV2 vectors in Hela cells using cell surface and intracellular flow cytometry (FC) staining confirmed single and dual S and N antigen expression by the single and double recombinant vaccine vectors. Staining with S-specific antibodies revealed abundant cell surface and intracellular antigen expression by all vectors encoding the S antigen (sMVA-S, sMVA-N/S, sMVA-S/N) (FIG. 5E). In contrast, staining with anti-N antibody revealed predominantly intracellular antigen expression by all vectors encoding the N antigen (sMVA-N, sMVA-N/S, sMVA-S/N) (FIG. 5E), although cell surface staining was also observed to a minor extent. S and N antigen expression by the sMVA-CoV2 vectors was also investigated by immunofluorescence. This analysis confirmed co-expression of the S and N antigens by the double recombinant vaccine vectors and indicated efficient cell surface and intracellular expression of the S antigen, whereas the expression of the N antigen was predominantly observed intracellular (FIGS. 6A-6C). Furthermore, immunofluorescence imaging in addition to intracellular flow cytometry by dual antibody staining demonstrated co-expression of the S and N antigens within the same cell by the double recombinant sMVA-CoV2 vectors (FIGS. 6A-6D). These results demonstrate efficient antigen expression by the single and double recombinant sMVA-CoV2 vectors.

Example 6: In Vivo Immunogenicity of sMVA-CoV2 Vectors

To determine the immunogenicity of the sMVA-vectored S and N antigens alone or combined, SARS-CoV-2-specific humoral and cellular immune responses were evaluated in Balb/c mice by two immunizations with the single or double recombinant vaccine vectors. High-titer antigen-specific binding antibodies were detected in all vaccine groups after the first immunization, and an increase in these responses was observed after the booster immunization (FIGS. 7A-7B and 8A-8B). While the single recombinant vectors induced binding antibodies only against the S or N antigen, the double recombinant vectors induced binding antibodies against both the S and N antigens. In addition, all sMVA-CoV2 vectors encoding the S antigen (sMVA-S, sMVA-S/N, sMVA-N/S) stimulated high-titer binding antibodies against the S receptor binding domain (RBD), which is considered the primary target of NAb[22,24]. Antigen-specific binding antibody titers between the single and double recombinant vaccine groups were comparable. Notably, SARS-CoV-2 antigen-specific binding antibody responses stimulated by the sMVA-CoV2 vaccine vectors in mice exceeded SARS-CoV-2 S-, RBD-, and N-specific binding antibody responses measured in human convalescent immune sera (FIGS. 7A-7B, and 9). Similar binding antibody responses to those induced by sMVA-CoV2 vectors in Balb/c mice were elicited by the vaccine vectors in C57BL/6 mice (FIG. 10). Analysis of the IgG2a/IgG1 isotype ratio of the binding antibodies revealed Th-1-biased immune responses skewed toward IgG2a independently of the investigated vaccine group or antigen (FIGS. 7C and 8C).

Potent SARS-CoV-2-specific NAb responses as assayed using pseudovirus were detected after the first immunization in all vaccine groups receiving the vectors encoding the S antigen (sMVA-S, sMVA-S/N, sMVA-N/S), and these NAb responses increased after the booster immunization (FIGS. 7D-7E and 8D-8E). Similar potent NAb responses as measured using pseudovirus were observed in the vaccine groups using infectious SARS-CoV-2 virus (FIGS. 7F-7G and 8F-8G). The immune sera for potential antibody-dependent enhancement of infection (ADE) were evaluated using THP-1 monocytes. These cells do not express the ACE2 receptor, but express Fcγ receptor II, which is considered the predominant mediator of ADE in SARS-COV infection[41]. THP-1 monocyte infection by SARS-CoV-2 pseudovirus was not promoted by the immune sera of any of the vaccine groups even at sub-neutralizing antibody concentrations (FIG. 11), suggesting absence of Fc-mediated ADE by antibodies induced by the vaccine vectors.

SARS-CoV-2-specific T cells evaluated after the second immunization by ex vivo antigen stimulation revealed both S- and N-specific T cell responses in the vaccine groups receiving the double recombinant vectors sMVA-S/N and sMVA-N/S. In contrast, mice receiving the single recombinant vectors sMVA-N or sMVA-S developed T cell responses only against either the N or S antigen (FIGS. 12A-12D, 13, and 14). High levels of cytokine-secreting (IFNγ, TNFα and IL-4) S-specific CD8+ T cells were measured in all vaccine groups immunized with the S-encoding sMVA-CoV2 vectors (FIG. 12A). S-specific CD4+ T-cells mostly produced Th1 cytokines (IFNγ and TNFα), while production of Th2 cytokines (IL-4 and IL-10) did not increase following antigen stimulation (FIGS. 12C, 14), indicating a Th1-biased response. While activated N-specific CD8+ T cells were not detected at significant frequency (FIG. 12B), N-specific IFNγ and to some degree TNFα-secreting CD4+ T cells were measured in all animals vaccinated with the single and double recombinant vectors encoding N (FIGS. 12D and 14). No significant differences were observed in the T cell levels of the single and double recombinant vaccine groups.

Stimulation of SARS-CoV-2-specific immune responses by both the S and N antigens was also evaluated in mice by co-immunization using the single recombinant vectors sMVA-S and sMVA-N at different doses. This study revealed similar SARS-CoV-2 antigen-specific humoral and cellular immune responses in vaccine groups receiving sMVA-S and sMVA-N alone or in combination (FIGS. 15 and 16). Altogether these results indicate that the sMVA-vectored S and N antigens when expressed alone or combined using a single vector or two separate vectors can stimulate potent SARS-CoV-2-specific humoral and cellular immune responses in mice.

Example 7: In Vivo Immunogenicity of COH04S1 in Mice

Mice immunized with sMVA vaccine, COH04S1, either once or twice, demonstrated high titers of binding antibodies, neutralizing antibodies and T cell reactivity. These results suggest that COH04S1 is highly immunogenic in mice. See Table 2 below. NT50/90 is the dilution of the (antibody-containing) serum still showing 50/90% neutralization of infection. In combination with extensive prior safety and clinical experience of MVA and as a platform to address future variants of coronaviruses, the vaccine disclosed herein has potentially significant clinical use.

Spike antigen. sMVA vaccine expressing only Spike antigen is shown (sMVA-S), sMVA vaccine expressing only Nucleocapsid antigen is shown (sMVA-N), sMVA vaccine expressing both Spike(S) and Nucleocapsid (N) antigens is shown (COH04S1), sMVA vector without SARS-COV-2 insert is shown (sMVA), and the mock vaccination is shown (mock). Neutralizing antibodies were measured using live SARS-COV-2 to infect HeLa-Ace2 cells.

FIG. 22 shows that COH04S1 elicited potent SARS-CoV-2-specific neutralizing antibodies (Nab) in mice (using live SARS-CoV-2 virus). NAbs effectively blocked infection of SARS-CoV-2 infectious virus. The NAb tittered 1-2 orders of magnitude above titers that are considered protective for SARS-CoV-2 infection.

FIG. 23 shows that C46 did not demonstrate evidence of characteristic synonymous with antibody-dependent enhancement (ADE) of infection. The left panel shows HEK cells expressing human ACE2 protein. Pseudovirus infection was successfully prevented by antibodies generated after infection of mice with C46 as well as a single S-expressing vector. No inhibition of infection by controls and no ADE (this would show as RLU units above upper dotted line) by

TABLE 2

| Summary of mouse immunogenicity elicited by COH04S1 | | |
| --- | --- | --- |
| 1 | Total SARS-CoV-2 binding antibodies | Endpoint titer: approx. $10^5$ | Endpoint titer: approx. $10^6$ |
| 2.1 | T-cell immune response | Both for Spike and Nucleocapsid: CD4$^+$ and | |
| 2.2 | | CD8$^+$ T cells show Th1 polarization (indicative of cell-mediated immunity against pathogens), predominantly releasing TNFα and IFNγ | |
| 3 | Neutralizing antibodies | NT50*: approx. $10^3$ NT90: 2.2-2.5*$10^2$ | NT50: approx. $10^4$ NT90: 3-4*$10^3$ |
| 4 | Antibody-dependent enhancement of infection | None found | None found |

FIG. 18 demonstrates high titers of total binding antibodies directed against Spike (S), Receptor Binding Domain (RBD) and Nucleocapsid (N) antigen shown after first (top panels) and second (bottom panels) immunization with C46 expressing both S and N antigens. The antibody titers compared favorably with antibody titers in convalescent human sera (dotted lines). S-specific antibody responses effectively bound to mutated S (D614G) antigen (data not shown).

FIG. 19 demonstrates antigen-specific CD4+ (left side) and CD8+ (right side) T cell responses in mice vaccinated with dual antigen construct sMVA-N/S (C35) as well as single- and no-antigen and control. IFNγ and TNFα cytokine production demonstrates robust anti-Spike Th1 cytokine response. Absence of response to IL-4 (and IL-10, data not shown) points to lack of Th2 response.

FIG. 20 shows the ratios of IGg2a to IgG1 and IFNγ to IL-4 secretion, demonstrating that vaccination with sMVA-N/S (C35) resulted predominantly in a humoral and cellular Th1 response (which is instrumental in cell-mediated immunity against pathogens), not a Th2 response. Vaccination with Spike antigen mixed with Alum adjuvant (prototype adjuvant for induction of a Th2 response) is shown as control on the right in each panel.

FIG. 21 shows antibodies in mouse serum after one ("post-prime") or two ("post-boost") immunizations with dual-antigen COH04S1, single-antigen and empty vectors as well as mock control demonstrate effective development of neutralizing antibodies when using vectors expressing the serum antibodies from mice treated with any vector was observed. This panel was the positive control showing that the vaccine was working. The middle panel shows the THP-1 monocytic cell line, not expressing ACE2 receptor (and therefore not capable of being infected by SARS-CoV-2 virus) but expressing Fc receptors (which are suspected in causing ADE). No infection and no ADE were observed in this experiment (no increase above the dotted line). The right panel shows THP-1 cells, positive control infection with VSV vector. No reduction of this infection in the presence of antibodies from treated mice, and no ADE effect observed in the presence of these antibodies either (RLU did not increase above the upper dotted line). RLU represents relative luciferase units, a measure of the degree of infection in this system.

FIG. 24 shows that COH04S1 induced strong humoral and cellular immune responses in mice following intraperitoneal (IP) and intranasal (IN) vaccinations.

Figures 25A, 25B:
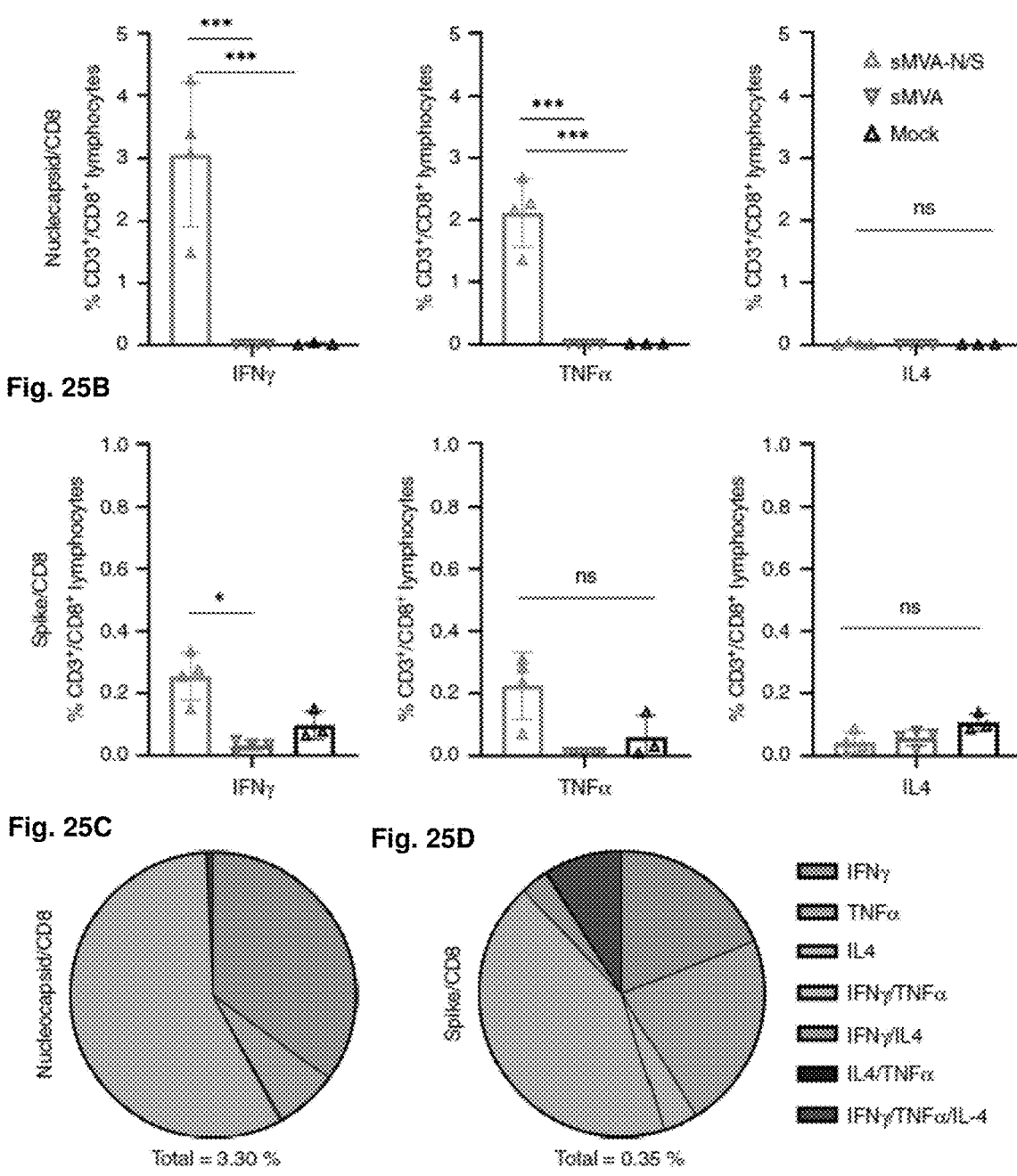

To further assess the immunogenicity of the sMVA-vectored N antigen, the double recombinant vaccine vector sMVA-N/S was evaluated for antigen-specific T-cell stimulation in transgenic C57BL/6 mice expressing the human leukocyte antigen (HLA)-B*0702 (B7). This HLA type has been recently described to present immunodominant N-specific peptides that are frequently recognized in SARS-CoV-2-infected patients. C57BL/6 B7 mice immunized with sMVA-N/S developed high-frequency N-specific CD8+ T cells secreting IFNγ and TNFα that reached over 2-3% of the total CD8+ T-cell population (FIG. 25A). S-specific CD8+ cells secreting IFNγ were also detected at significant levels in sMVA-N/S-immunized C57BL/6 B7 mice, albeit at lower frequency compared to the N-specific T-cell responses (FIG. 25B). N- or S-specific CD8+ T cells secreting IL-4 were not observed in significant levels in sMVA-N/S-immunized animals. Notably, sMVA-N/S-stimulated CD8+ T cells to both the N and S antigens in C57BL/6 B7 mice were largely polyfunctional, with more than half of the N-specific CD8+ T cells secreting IFNγ and TNFα combined (FIGS. 25C and 25D). Further analysis by IFNγ ELISPOT revealed that the S-specific T-cell responses induced by sMVA-N/S in C57BL/6 B7 mice were mostly directed toward epitopes of the S2 domain (FIG. 26). In addition, a significant response was measured in sMVA-N/S-immunized B7 mice following stimulation with an HLA-B*0702 immunodominant N-specific peptide epitope (SPRWYFYYL, SEQ ID NO: 90) that has been shown recently to be recognized by a high proportion of people recovering from COVID-19 disease (FIG. 26). FIG. 26 shows that a major component of the response to Spike antigen is to the S2 domain. The N library is well recognized as it is in humans. A significant component was identified as a previously described N peptide: N26

(SEQ ID NO: 89)
MKDLSPRWYFYYLGT.

Bold and underlined is the epitope that is described in humans: Peng, Y., Mentzer, A. J., Liu, G. et al., Broad and strong memory CD4+ and CD8+ T cells induced by SARS-CoV-2 in UK convalescent individuals following COVID-19. Nat Immunol (2020). doi.org/10.1038/s41590-020-0782-6. These results demonstrate that both the sMVA-vectored N and S antigens are immunogenic in HLA B*0702 transgenic mice, while the CD8+ T-cell response targeting N appears to be immunodominant.

Example 8: In Vivo Immunogenicity of COH04S1 in Hamsters

COH04S1 immunogenicity and protection study was carried out using 6-8 weeks old golden Syrian hamsters (Mesocricetus auratus). The aim of the study was to test immunogenicity and protective efficacy of SARS-CoV-2 vaccine candidates based on the City of Hope (COH) synthetic MVA platform in golden Syrian hamsters.

The Syrian Golden Hamster was chosen as a small animal model due to the greater resemblance of compared model COVID-19 disease symptoms in this to human disease and in comparison to other small animal models, allowing for an assessment of the impact of the various vaccines including COH04S1 on preventatives and reduction in disease severity.

A total of 90 golden Syrian hamsters, evaluated in 15 groups described in Table 3 were used to evaluate synthetic SARS-CoV-2 sMVA vaccine candidates via the intramuscular and intranasal routes. In addition to COH04S1, sMVA constructs expressing wild-type or 2P S (Spike) and N (Nucleocapsid) or S alone were tested. This analysis included parental sMVA-N/S vector C35 co-expressing wild-type forms of S and N antigens (FIG. 5), clinical isolate COH04S1 (C35/F4/B1) derived by double plaque purification process from C35 (FIGS. 17 and 57), another double plaque-purified isolate (C35/F4/D5) derived from C35; a double plaque-purified isolate (C46/C3/F10) derived from sMVA-S/N vector C46 (FIG. 5), an sMVA vector co-expressing N together with a prefusion stabilized form of the S antigen with 2P alteration (C79), and sMVA-S vector C15 expressing only wild-type S. Control groups were sMVA empty vector and mock-immunized animals. Animals were immunized either intramuscularly (IM) or intranasally (IN) with 1×10$^8$ pfu of sMVA recombinants.

TABLE 3

| | | | | | | | | |
|---|---|---|---|---|---|---|---|---|
| | | | Study Groups/Experimental Design | | | | | |
| | | | Treatment | | | Challenge | Weight and | Blood | |
| Gr | N | Material(Dose) | Route | Days | (IN) | Clin. Obs. | Collection | Termination |
| 1 | 6 (3F/3M) | sMVA (1e8) | IM | 0, 28 | Day 42 | Daily weights | Up to 5 | Day 52 |
| 2 | 6 (3F/3M) | C79 (S2P/N) (1e8) | IM | | SARS- | and BID | | Nasal wash |
| 3 | 6 (3F/3M) | COH04S1 (1e8) | IM | | CoV-2 | observation | | BAL |
| 4 | 6 (3F/3M) | C35/F4/D5 (S/N) (1e8) | IM | | 50 | during | | Collect lungs, |
| 5 | 6 (3F/3M) | C46/C3/F10 (S/N) (1e8) | IM | | μL/nostril | challenge | | trachea, nasal |
| 6 | 6 (3F/3M) | C15 (S) (1e8) | IM | | | period | | turbinates, |
| 7 | 6 (3F/3M) | C35 (S/N) (1e8) | IM | | | | | brain, kidney, |
| 8 | 6 (3F/3M) | sMVA (1e8) | IN | | | | | GI tract |
| 9 | 6 (3F/3M) | C79 (S2P/N) (1e8) | IN | | | | | |
| 10 | 6 (3F/3M) | COH04S1 (1e8) | IN | | | | | |
| 11 | 6 (3F/3M) | C35/F4/D5 (S/N) (1e8) | IN | | | | | |
| 12 | 6 (3F/3M) | C46/C3/F10 (S/N) (1e8) | IN | | | | | |
| 13 | 6 (3F/3M) | C15 (S) (1e8) | IN | | | | | |
| 14 | 6 (3F/3M) | C35 (S/N) (1e8) | IN | | | | | |
| 15 | 6 (3F/3M) | Mock | N/A | N/A | | | | |

FIG. 27 shows that aged mice immunized with COH04S1 clinical isolate developed comparable immune responses to young mice following prime-boost immunization.

FIG. 28 shows the immunogenicity of COH04S1 clinical isolate. COH04S1 shows comparable immunogenicity between sexes in Balb/C mice and demonstrates Th1 immunity compared to S/N/Alum to all antigens.

Vaccine constructs were administered to the animals via the indicated route at the specified dose on Day 0 followed by boost administration on day 28. Serum was evaluated for binding antibodies and SARS-CoV-2 authentic virus neutralization at the timepoints indicated (FIG. 29). Six animals per group (3 female and 3 male hamsters) were immunized in a prime-boost schedule with 1×10$^8$ pfu of COH04S1 or 1×10$^8$ pfu of sMVA empty control vector via the intramuscular or the intranasal routes.

Post-immunization analyses included detection of Spike- and Nucleocapsid-specific binding antibodies and quantification of neutralizing antibodies by both live SARS-CoV-2 virus and Spike-pseudovirus.

Two weeks post-boost, animals were challenged with $6\times10^4$ pfu of SARS-CoV-2, Isolate USA-WA1/2020 (NR-52281, BEI Resources). At 10 days post challenge, the animals were euthanized, and the organs were collected for determination of virus titer, gross pathology and histopathological assessments. Weight loss over time and clinical observations were taken twice daily.

Humoral Response

Total IgG binding antibodies to S, RBD and N were measured in hamster serum four weeks post-prime (day 28) and two weeks post-boost (day 42). Binding antibodies were not detected in control animals. In contrast, all sMVA-SARS-CoV-2 immunized animals developed binding antibodies to S, RBD, and N post-prime and titers were increased by a second dose (FIG. 30). Comparable titers were measured in IM- and IN-immunized hamsters.

Sera collected on days 28 and 42 were evaluated for the presence of neutralizing antibodies (NAb) using a PRNT SARS-CoV-2 assay.

As shown in Table 4 and FIG. 31, control animals did not develop NAb (IC50<20). Low titer NAb were detected in few animals post-prime and appeared to be higher after IN immunization although results are not available for all the animals. Post-boost NAb titers increased and ranged between 60 and >4860 (assay upper limit of detection).

TABLE 4

PRNT assay results

| Animal # | Group | Treatment | Route | Day 28 Titer (IC$_{50}$) | Day 41 Titer (IC$_{50}$) |
|---|---|---|---|---|---|
| 6310 | 1 | sMVA | IM | | <20 |
| 6311 | | | | | <20 |
| 6312 | | | | | <20 |
| 6313 | | | | | <20 |
| 6314 | | | | | <20 |
| 6315 | | | | | <20 |
| 6316 | 2 | S2P/N | IM | | 1620 |
| 6317 | | (C79) | | | 540 |
| 6318 | | 1e8 | | | 180 |
| 6319 | | | | | 60 |
| 6320 | | | | | 540 |
| 6321 | | | | | 180 |
| 6322 | 3 | COH04S1 | IM | | 540 |
| 6323 | | (C35/F4/B1) | | | 540 |
| 6324 | | 1e8 | | | 540 |
| 6325 | | | | | 540 |
| 6326 | | | | | 540 |
| 6327 | | | | | 540 |
| 6328 | 4 | S/N | IM | | 540 |
| 6329 | | (C35/F4/D5) | | | 180 |
| 6330 | | 1e8 | | | 180 |
| 6331 | | | | | 180 |
| 6332 | | | | | 60 |
| 6333 | | | | | 180 |
| 6334 | 5 | S/N | IM | | 180 |
| 6335 | | (C46/C3/F10) | | | 180 |
| 6336 | | 1e8 | | | 180 |
| 6337 | | | | | 180 |
| 6338 | | | | | 180 |
| 6339 | | | | | 60 |
| 6340 | 6 | S | IM | 20 | 180 |
| 6341 | | (C15) | | <20 | 180 |
| 6342 | | 1e8 | | 20 | 540 |
| 6343 | | | | 60 | 540 |
| 6344 | | | | <20 | 540 |
| 6345 | | | | <20 | 180 |
| 6346 | 7 | S/N | IM | <20 | 1620 |

TABLE 4-continued

PRNT assay results

| Animal # | Group | Treatment | Route | Day 28 Titer (IC$_{50}$) | Day 41 Titer (IC$_{50}$) |
|---|---|---|---|---|---|
| 6347 | | (C35) | | <20 | 180 |
| 6348 | | 1e8 | | <20 | 540 |
| 6349 | | | | <20 | 180 |
| 6350 | | | | <20 | 60 |
| 6351 | | | | <20 | 540 |
| 6352 | 8 | sMVA | IN | <20 | <20 |
| 6353 | | | | <20 | <20 |
| 6354 | | | | <20 | <20 |
| 6355 | | | | <20 | <20 |
| 6356 | | | | <20 | <20 |
| 6357 | | | | <20 | <20 |
| 6358 | 9 | S2P/N | IN | 60 | 180 |
| 6359 | | (C79) | | 180 | 540 |
| 6360 | | 1e8 | | 60 | 1620 |
| 6361 | | | | 180 | 1620 |
| 6362 | | | | 20 | 1620 |
| 6363 | | | | 180 | 1620 |
| 6364 | 10 | COH04S1 | IN | 180 | 1620 |
| 6365 | | (C35/F4/B1) | | 60 | 540 |
| 6366 | | 1e8 | | 20 | 540 |
| 6367 | | | | <20 | 180 |
| 6368 | | | | <20 | 540 |
| 6369 | | | | <20 | 60 |
| 6370 | 11 | S/N | IN | | 1620 |
| 6371 | | (C35/F4/D5) | | | 180 |
| 6372 | | 1e8 | | | 540 |
| 6373 | | | | | 540 |
| 6374 | | | | | 540 |
| 6375 | | | | | 540 |
| 6376 | 12 | S/N | IN | | 60 |
| 6377 | | (C46/C3/F10) | | | 540 |
| 6378 | | 1e8 | | | 180 |
| 6379 | | | | | 540 |
| 6380 | | | | | 60 |
| 6381 | | | | | 180 |
| 6382 | 13 | S | IN | | 180 |
| 6383 | | (C15) | | | 540 |
| 6384 | | 1e8 | | | 540 |
| 6385 | | | | | 60 |
| 6386 | | | | | 540 |
| 6387 | | | | | 60 |
| 6388 | 14 | S/N | IN | | 180 |
| 6389 | | (C35) | | | 180 |
| 6390 | | 1e8 | | | 1620 |
| 6391 | | | | | 1620 |
| 6392 | | | | | 1620 |
| 6393 | | | | | >4860 |
| 6394 | 15 | Mock | N/A | | <20 |
| 6395 | | | | | <20 |
| 6396 | | | | | <20 |
| 6397 | | | | | <20 |
| 6398 | | | | | <20 |
| 6399 | | | | | <20 |

Body Weight Analysis

Hamsters were challenged two weeks post-boost with $6\times10^4$ pfu of SARS-CoV-2, Isolate USA-WA1/2020, and the weight changes were measured daily for 10 days. Hamsters immunized IM with sMVA-S/N, N/S, S vaccines showed an initial minor weight loss comparable to control animals. Starting from day 3 post-challenge sMVA-S/N, N/S, S-immunized animals started recovering their weight while control animals kept losing weight. Control animals' weight dipped at day 7 to a mean value of −15% and started increasing thereafter. Between day 3 post-challenge and the final time-point 10-days post-challenge the difference in weight between sMVA-SARS-S/N, N/S, S and control animals was significant (FIGS. 32 and 33).

Similar results were obtained with sMVA-S/N, N/S, S-IN immunized animals. SMVA-S/N, N/S, S given intranasally prevented weight loss in challenged animals in comparison to mock-immunized and sMVA IN-immunized hamsters. The difference was significant from day 2 until the end of the study (FIGS. 32 and 33). No difference was observed amongst all tested recombinant vaccines, independently from the route of administration. Additionally, no difference in weight loss was observed between female and male hamsters (FIG. 33).

Effects of COH04S1

COH04S1 IM- and IN-immunized animals developed comparable binding antibody titers to S, RBD and N both post-prime and post-boost (FIG. 34). Additionally, analysis of the antibody isotype indicated a Th1-biased response with an IgG2-3/IgG1 ratio strongly shifted toward the Th1 Iso-types IgG2 and IgG3. Six out of six IM-immunized COH04S1 hamsters had high titer NAb with a geometric mean IC50 of 540. COH04S1 IN-immunized animals had titers between 180 and 1620 with a median titer of 540. COH04S1 administered IM or IN protected the animals from weight loss following a sub-lethal challenge with authentic SARS-CoV-2 virus (FIG. 35).

The lungs, turbinates and nasal wash collected at day 10 post-challenge were analyzed for the presence of SARS-CoV-2 genomes by genomic RNA qPCR (FIG. 36). At day 10 post-challenge, mock-immunized and sMVA-immunized hamsters still had high viral load in lungs, turbinates and in nasal washes. COH04S1 IM- and IN-immunized animals' samples showed significantly reduced gRNA amounts in lungs, turbinates and in nasal wash with the highest difference measured in lungs indicative of COH04S1-mediated protection.

Example 9: In Vivo Immunogenicity and Protective Efficacy of COH04S1 in African Green Monkeys African green monkeys (AGMs) support a high level of SARS-CoV-2 replication and develop pronounced respiratory disease that can be more substantial than in other NHP species including cynomolgus and rhesus macaques translating to greater comparability to symptoms of COVID-19 presentation in humans.

In this study, outbred AGMs of different sex and weight (Table 5) were vaccinated with COH04S1 intramuscularly (IM) with one or two doses and vaccine immunogenicity and protective efficacy were evaluated.

TABLE 5

| Group | Study | ID# | Weight (kg) | Sex |
|---|---|---|---|---|
| AGM weight and sex distribution across groups | | | | |
| 1 | 1 | D4697 | 4.76 | F |
| (Saline Control) | | D4649 | 3.02 | F |
| | | D4062 | 3.78 | F |
| | 2 | D4645 | 3.56 | F |
| | | D4756 | 3.45 | F |
| | | D3505 | 6.79 | M |
| 2 | 1 | D4187 | 4.03 | F |
| (Mock Vaccine, sMVA) | | D3783 | 3.31 | F |
| | | D3704 | 3.63 | F |
| | 2 | D4595 | 3.41 | F |
| | | D4079 | 3.73 | F |
| | | D3506 | 6.05 | M |
| 3 | 1 | C4403 | 4.02 | F |
| (COH04S1) | | D4877 | 2.91 | F |
| | | D4407 | 3.69 | F |
| | | D4389 | 3.68 | F |
| | | D4863 | 3.37 | F |
| | | D4732 | 7.23 | M |
| | 2 | D3308 | 3.79 | F |
| | | D4596 | 3.83 | F |

TABLE 5-continued

| Group | Study | ID# | Weight (kg) | Sex |
|---|---|---|---|---|
| AGM weight and sex distribution across groups | | | | |
| | | D3808 | 2.95 | F |
| | | D4678 | 3.86 | F |
| | | D4640 | 3.36 | F |
| | | B2749 | 5.63 | M |

The AGMs received either one (study two) or two (study one) immunizations with $5 \times 10^8$ pfu or $2.5 \times 10^8$ pfu of sMVA recombinants, respectively. Three AGMs in each study received either mock saline immunization or empty sMVA vector as controls. Six AGMs in each study were immunized with COH04S1 in a prime (study 2) or prime-boost (Study 1) setting (FIG. 38). Blood and serum samples were collected at different timepoints for the analysis of cellular and humoral immunity. Six weeks post prime (study 2) or six weeks post-boost (study 1) the AGMs were challenged with $1 \times 10^5$ pfu of SARS-CoV-2. The animals were observed, weighed and the temperature was taken daily for the first week and every other day for the following two weeks. On each sampling day, nasal, oral and anal swabs were collected. Broncho alveolar lavages (BAL) were collected on days 2, 4, 7, 10 and 21 post-challenge. At day 7 post-challenge 1 mock animal, 2 sMVA control animals and 3 COH04S1-immunized animals in both studies were sacrificed and organs were collected for virus quantification and histopathology. At day 21 post-challenge the remaining animals in both studies were sacrificed and organs collected for virological and immunological studies.

Starting from 2 weeks post-prime (study 2) and 2 weeks post-boost (study 1), T cell responses to Spike (S) and Nucleocapsid (N) antigens were evaluated in freshly isolated PBMCs by IFNγ/IL-2/IL-4 ELISPOT (FIGS. 39-41). Prime-only animals tended to have lower S- and N-specific IFNγ T cells levels than prime-boost animals. However, the recall response post-challenge was higher in prime only animals than in prime-boost animals. The COH04S1-immunized AGMs developed robust IFNγ T-cell responses to S and N that were absent in control animals and increased at day 7 post-challenge, indicative of an anamnestic response to the challenge virus (FIG. 39). IL-2 responses followed closely IFNγ responses although at lower levels. IL-4 T cell responses, indicative of a pathologic inflammatory response, were very low or absent in all COH04S1-immunized animals (FIGS. 40-41).

BAL samples were evaluated for the presence of SARS-CoV-2 challenge virus by genomic RNA (gRNA) quantification and plaque quantification (tissue culture infectious dose 50, TCID50). Differently from sub-genomic RNA (sgRNA) and TCID50 which only measure replicating virus, gRNA is a measure of both input challenge virus and replicating virus and especially at early time points post-challenge can be highly contaminated with input virus. At day 2 post-challenge, both prime and prime-boost COH04S1 animals showed significantly reduced gRNA copies in BAL samples than control animals (FIG. 42). One COH04S1-vaccinated animal in each study had undetectable virus in BAL. At day 4 post-challenge there was a trend to lower gRNA copies in vaccinated animals in comparison to controls but the difference was not significant.

Viral load in BAL samples taken on days 2, 4, and 7 post-challenge was quantified by plaque assay (FIGS. 43-44). On day 2 post-challenge there was a significant reduction in vial load in samples from animals immunized with COH04S1 in comparison to controls. One animal on study one, and three animals on study 2 had undetectable virus in BAL samples on day 2 post-challenge. By day 7 post-challenge all COH04S1-immunized animals except for an AGM on study 1 had viral load below the lower limit of detection of the assay. In contrast, all control animals in both studies still had measurable virus in the lungs on day 7 post-challenge. These results demonstrate that COH04S1 administered either as one or two injections can rapidly protect AGM lower airways from SARS-CoV-2 virus infection.

Example 10: Phase I Clinical Trial of COH04S1 for Prevention of COVID-19

COH04S1 was evaluated in healthy adults in a dose escalation clinical trial (NCT04639466) to identify adverse events and an optimal dose. Safety and tolerability of the COH04S1 vaccine were evaluated at three different dose levels (DLs): $1.0 \times 10^7$ plaque-forming unit (PFU)/dose, $1.0 \times 10^8$ PFU/dose, and $2.5 \times 10^8$ PFU/dose. For each DL, 4-6 open label sentinels were included.

COH04S1 Phase I clinical trial was performed at 3 dose levels (DL1-3) with 4-6 open-label sentinels at each DL followed by 35 injected healthy research subjects randomized against placebo. DL1 corresponds to $1 \times 10^7$ PFU/dose, same low dose as used in mice. DL2 corresponds to $1 \times 10^8$ PFU/dose, and DL3 corresponds to $2.5 \times 10^8$ PFU/dose. All doses are compatible with large scale production. Prime-boost immunizations were safely given to 16 out of 17 (one DL2 sentinel withdrew from the study after only receiving prime vaccination) sentinels, and COH04S1 was safe and well tolerated in DL1, DL2 and DL3 sentinels. All sentinels tested seroconverted to S and N antigens and developed Th1 T cell responses. All sentinels tested developed neutralizing antibodies.

Binding Antibodies

Four DL1 open label sentinels were evaluated for development of IgG binding antibodies to Spike (S), S receptor binding domain (RBD) and Nucleocapsid (N) up to day 120 using ELISA (FIG. 45A). In all DL1 sentinels at all time points, S-specific binding antibodies were measurable and tended to increase post-boost. RBD-specific binding antibodies were not present post-prime in ¾ DL1 sentinels. Post-boost levels were comparable or slightly lower than median levels measured in a pool of 35 SARS-CoV-2 convalescent individuals that had mild-to-severe COVID-19 disease. N-specific binding antibody levels were variable amongst DL1 sentinels. Post-boost N-specific binding antibodies were detectable in all DL1 sentinels post-boost with levels as high as those measured in convalescent individuals.

Five DL2 sentinels were evaluated for development of IgG binding antibodies to S, RBD and N through day 90 (FIG. 45B). Similar to DL1 sentinels, in all five DL2 sentinels binding antibodies to S developed shortly after the first vaccination with COH04S1 and were boosted by a second dose. RBD-binding antibodies were measured in 4 out of 5 DL2 sentinels post-prime immunization and reached higher titers post-boost comparable to titers measured in convalescent serum. DL2 sentinels developed variable levels of N-specific binding antibodies with 5 out of 5 sentinels showing measurable levels of N-specific IgG by day 56.

S-, RBD-, and N-specific binding antibodies were evaluated in 6 DL3 sentinels up to day 56 (FIG. 45C). All DL3 sentinels readily developed S-specific binding antibodies post-prime. In 2 out of 6 DL3 sentinels S-specific IgG titers were not boosted by a second dose. In the remaining 4 DL3 sentinels S-IgGs increased after the boost at given day 28. RBD-specific binding antibodies were higher than baseline in 4 out of 6 DL3 sentinels, including one DL3 sentinel that post-prime reached higher titers than those measured in convalescent serum. Post-boost all DL3 sentinels had RBD-specific binding antibodies with titers approaching or comparable to titers measured in convalescent serum. N-specific binding antibodies were diverse amongst DL3 sentinels, although tended to reach higher titers post-prime in comparison to DL1 and DL2 sentinels. By day 42, 6 out of 6 DL3 sentinels had measurable N-specific binding antibodies.

IgG titers to S, RBD and N in DL1/DL2/DL3 sentinels were compared to titers measured in a group of City of Hope employees who received two doses of EUA vaccine (Pfizer/BioNTech) at day 60 and 90 post prime immunization. Additionally, titers from COH04S1 vaccines were compared to titers measured in a pool of 35 SARS-CoV-2 convalescent individuals that had mild-to-severe COVID-19 disease (FIG. 46). Overall, S-, RBD- and N-specific antibodies induced after two doses of COH04S1 were comparable to those in EUA vaccine recipients and/or convalescent plasma from individuals recovered from mild-to-severe COVID-19 disease. Booster immunization increased titers especially for RBD binding antibodies.

To address the most recent SARS-CoV-2 variant viruses, DL1/DL2/DL3 sentinel serum samples were evaluated for binding to P.1 Brazilian SARS-CoV-2 variant Spike and compared to binding to Spike from the original SARS-CoV-2 Wuhan strain (FIG. 47). DL1 sentinel serum samples bound less efficiently to P.1 Spike in comparison to Wuhan Spike resulting in lower titers. In contrast, at all timepoints, DL2 and DL3 sentinels had similar titers to P.1 Spike and Wuhan Spike with most DL3 sentinels having comparable titers or higher titers to P.1 Spike than Wuhan Spike at day 56.

Neutralizing Antibodies

Neutralizing antibodies against the D614G variant of the ancestral Wuhan Spike amino acid sequence and against the widespread UK (B.1.1.7), the Republic of South African (RSA, B.1.351), and Brazilian (BRA, P.1) VOC were measured using an in vitro microneutralization assay and lentivirus-based pseudoviruses of each strain (FIG. 48). All Spike sequences included the D614G mutation and had a truncation of the last 19 amino acids at the C-terminus (KFDEDDSEPVLKGVKLHYT, SEQ ID NO: 65).

In concordance with the timing of development of RBD-specific binding antibodies, neutralizing antibodies against the three strains were low or not measurable post-prime in DL1 sentinels with the exception of one DL1 sentinel who immediately developed NT50 between 50 and 100 for the reference strain, UK and Brazilian VOC at day 14 post-prime. A significant increase in titers was observed in the other 3 DL1 sentinels post-boost reaching NT50 titers up to 150. All three strains were neutralized with variable potency and titers were stable through day 56. At days 90 and 120, all DL1 sentinels had measurable neutralizing antibodies for at least one viral strain (ancestral Wuhan strain or VOC).

Of the 5 DL2 sentinels tested for neutralizing antibodies against the reference strain and the UK, RSA, and BRA VOC, 4 developed early neutralizing antibodies post-prime reaching peak NT50 titers up to 300. Overall, post-boost titers were more elevated than in DL1 sentinels with d56 NT50 geometric mean titers (GMT) titers of 212, 169, 64 and 119 against D614G (Wuhan), UK, RSA, and BRA VOC respectively (FIG. 49).

DL3 sentinels developed early high titer neutralizing antibodies in 2 out of 6 volunteers. The other 4 DL3 sentinels had low titer neutralizing antibodies post-prime which increased after a second dose of the vaccine. Overall, in DL3 sentinels titers of neutralizing antibodies to the D614G (Wuhan) strain and the UK, RSA, and BRA VOC was comparable to titers measured in DL2 sentinels and to titers measured using the same pseudoviruses in a cohort of EUA vaccine recipients (FIG. 49).

T Cell Responses

T cell responses were evaluated by IFNγ/IL-4 ELISPOT. Cryopreserved PBMCs were stimulated overnight in vitro with peptide pools covering the whole vaccine antigens S and N and additionally with SARS-CoV-2 viral membrane (M) antigen peptide pools. The Spike peptides were divided into four sub-pools with 71-86 peptides in each sub-pool and Elispot responses to each pool were added to give the total response to S antigen. All peptides covering N antigen were included in a single N antigen pool. Elispot responses in mock-stimulated samples (DMSO) were subtracted from each sample (FIGS. 50 and 51).

As shown in FIGS. 51 and 52, all 4 DL1 sentinels developed S- and N-specific IFN-γ T cell responses post-prime. T cells were boosted by a second immunization and were stable up to day 120 with a trend for higher S- and N-IFNγ responses. Levels of IL-4 secreting T cells were very low or absent after both S and N stimulation. M-specific response was absent in all DL1 volunteers. DL2 sentinels had higher IFN-γ T-cell response to both S and N than DL1 sentinels. Post-boost IFN-γ T cell responses were higher than post-prime for some subjects and lower for others. IL-4 response to S and N, suggestive of a Th2 phenotype of T helper cells, was low in all subjects. M-specific T cell responses were low or absent. DL3 sentinels IFN-γ T-cell response peaked post-prime and levels post-boost were lower than post-prime for most of the sentinels.

IFN-γ and IL-4 T cell responses in COH04S1 sentinels were compared to levels measured in a pool of Pfizer/BioNTech vaccine recipients at days 56-60 and 90 post prime-immunization (FIG. 53). At both day 56-60 and day 90 COH04S1 sentinels showed comparable levels of S-specific IFN-γ and IL-4 T cells to EUA vaccine recipients. N-specific IFN-γ T cell responses were significantly higher than in EUA vaccine recipients due to the inclusion of N antigen into COH04S1 but not in mRNA vaccines.

These results demonstrate that immunization with COH04S1 successfully induced strong Th1 T cell responses to S and N and desirably low Th2 responses. The T cell responses elicited by the vaccine compositions disclosed herein were comparable to other EUA and investigational vaccines.

Example 11: Construction of Additional sMVA Vaccines Based on SARS-CoV-2 Variants Using the synthetic vaccine platform, sMVA vectors co-expressing full-length S and N antigen sequences based on the SARS-CoV-2 variant lineage B.1.351 first identified in South Africa were generated. These sMVA constructs were derived from two independent virus reconstitutions and are herein referred to as C163 and C164. The C163 and C164 sMVA vectors were constructed as disclosed above similar to the C35 sMVA vaccine vector that formed the basis of the clinical product COH04S1, with the difference that the codon-optimized gene sequences based on the Wuhan reference strain that were inserted into the Del3 and Del2 site in C163 and C164 were further modified to encode for S and N antigens with several mutations specific for the B.1.351 lineage (see FIGS. 86 and 87 as well as 111 and 112 for specific sequences). The recombinant sMVA vectors included N501Y, E484K, K417N, L18F, D80A, D215G, Del242-244, R246I, D614G, and A701I mutations in the S antigen and a T205I mutation in the N antigen. Western Blot analysis confirmed the expression of the S1 and S2 domains of the S protein and the N protein by the C163/C164 variant vectors with similar expression levels compared to the original C35 vaccine construct (FIG. 54).

Using the synthetic vaccine platform, an sMVA vector co-expressing full-length S and N antigen sequences based on the SARS-CoV-2 variant lineage P.1 first identified in Brazil was generated. This sMVA construct is herein referred to as C170. The C170 sMVA vector was constructed as disclosed above similar to the C35 sMVA vaccine vector that formed the basis of the clinical product COH04S1, with the difference that the codon-optimized gene sequences based on the Wuhan reference strain that were inserted into the Del3 and Del2 site in C170 were further modified to encode for S and N antigens with several mutations specific for the P.1 lineage (see FIGS. 92 and 93 as well as 113 and 114 for specific sequences). The recombinant sMVA vector included N501Y, E484K, K417T, L18F, T20N, P26S, D138Y, R190S, H655Y, T1027I, and V1176F mutations in the S antigen and P80R, R203K, and G204R mutations in the N antigen. Western Blot confirmed the expression of the S1 and S2 domains of the S protein and the N protein by the C170 variant vector with similar expression levels compared to the original C35 vaccine construct (FIG. 55).

REFERENCES

The references, patents and published patent applications listed below, and all references cited in the specification above are hereby incorporated by reference in their entirety, as if fully set forth herein.

1. Volz, A. & Sutter, G. Modified Vaccinia Virus Ankara: History, Value in Basic Research, and Current Perspectives for Vaccine Development. Advances in virus research 97, 187-243 (2017).
2. Gilbert, S. C. Clinical development of Modified Vaccinia virus Ankara vaccines. Vaccine 31, 4241-4246 (2013).
3. Sutter, G. & Moss, B. Nonreplicating vaccinia vector efficiently expresses recombinant genes. Proceedings of the National Academy of Sciences of the United States of America 89, 10847-10851 (1992).
4. Antoine, G., Scheiflinger, F., Dorner, F. & Falkner, F. G. The complete genomic sequence of the modified vaccinia Ankara strain: comparison with other orthopoxviruses. Virology 244, 365-396 (1998).
5. Meisinger-Henschel, C. et al. Genomic sequence of chorioallantois vaccinia virus Ankara, the ancestor of modified vaccinia virus Ankara. The Journal of general virology 88, 3249-3259 (2007).
6. Carroll, M. W. & Moss, B. Host range and cytopathogenicity of the highly attenuated MVA strain of vaccinia virus: propagation and generation of recombinant viruses in a nonhuman mammalian cell line. Virology 238, 198-211 (1997).
7. Cottingham, M. G. & Carroll, M. W. Recombinant MVA vaccines: dispelling the myths. Vaccine 31, 4247-4251 (2013).
8. Wussow, F. et al. A vaccine based on the rhesus cytomegalovirus UL128 complex induces broadly neutralizing antibodies in rhesus macaques. Journal of virology 87, 1322-1332 (2013).

9. Wussow, F. et al. Human cytomegalovirus vaccine based on the envelope gH/gL pentamer complex. PLoS pathogens 10, e1004524 (2014).

10. Chiuppesi, F. et al. Multiantigenic Modified Vaccinia Virus Ankara Vaccine Vectors To Elicit Potent Humoral and Cellular Immune Reponses against Human Cytomegalovirus in Mice. Journal of virology 92 (2018).

11. La Rosa, C. et al. MVA vaccine encoding CMV antigens safely induces durable expansion of CMV-specific T cells in healthy adults. Blood 129, 114-125 (2017).

12. Aldoss, I. et al. Poxvirus Vectored Cytomegalovirus Vaccine to Prevent Cytomegalovirus Viremia in Transplant Recipients: A Phase 2, Randomized Clinical Trial. Annals of internal medicine 172, 306-316 (2020).

13. Yuan, Y. et al. Complete regression of cutaneous metastases with systemic immune response in a patient with triple negative breast cancer receiving p53MVA vaccine with pembrolizumab. Oncoimmunology 6, e1363138 (2017).

14. Zhou, P. et al. A pneumonia outbreak associated with a new coronavirus of probable bat origin. Nature 579, 270-273 (2020).

15. Zhu, N. et al. A Novel Coronavirus from Patients with Pneumonia in China, 2019. The New England journal of medicine 382, 727-733 (2020).

16. Lurie, N., Saville, M., Hatchett, R. & Halton, J. Developing Covid-19 Vaccines at Pandemic Speed. The New England journal of medicine (2020).

17. Smith, T. R. F. et al. Immunogenicity of a DNA vaccine candidate for COVID-19. Nature communications 11, 2601 (2020).

18. Yu, J. et al. DNA vaccine protection against SARS-CoV-2 in rhesus macaques. Science (2020).

19. Zhu, F. C. et al. Safety, tolerability, and immunogenicity of a recombinant adenovirus type-5 vectored COVID-19 vaccine: a dose-escalation, open-label, non-randomised, first-in-human trial. Lancet (2020).

20. Ni, L. et al. Detection of SARS-CoV-2-Specific Humoral and Cellular Immunity in COVID-19 Convalescent Individuals. Immunity (2020).

21. Long, Q. X. et al. Antibody responses to SARS-CoV-2 in patients with COVID-19. Nature medicine (2020).

22. Premkumar, L. et al. The receptor binding domain of the viral spike protein is an immunodominant and highly specific target of antibodies in SARS-CoV-2 patients. Science immunology 5 (2020).

23. Hoffmann, M. et al. SARS-CoV-2 Cell Entry Depends on ACE2 and TMPRSS2 and Is Blocked by a Clinically Proven Protease Inhibitor. Cell 181, 271-280 e278 (2020).

24. Walls, A. C. et al. Structure, Function, and Antigenicity of the SARS-CoV-2 Spike Glycoprotein. Cell 181, 281-292 e286 (2020).

25. Wrapp, D. et al. Cryo-EM structure of the 2019-nCOV spike in the prefusion conformation. Science 367, 1260-1263 (2020).

26. Grifoni, A. et al. Targets of T Cell Responses to SARS-CoV-2 Coronavirus in Humans with COVID-19 Disease and Unexposed Individuals. Cell (2020).

27. Merchlinsky, M. Mutational analysis of the resolution sequence of vaccinia virus DNA: essential sequence consists of two separate AT-rich regions highly conserved among poxviruses. Journal of virology 64, 5029-5035 (1990).

28. Baroudy, B. M., Venkatesan, S. & Moss, B. Structure and replication of vaccinia virus telomeres. Cold Spring Harbor symposia on quantitative biology 47 Pt 2, 723-729 (1983).

29. DeLange, A. M., Reddy, M., Scraba, D., Upton, C. & McFadden, G. Replication and resolution of cloned poxvirus telomeres in vivo generates linear minichromosomes with intact viral hairpin termini. Journal of virology 59, 249-259 (1986).

30. DeLange, A. M. & McFadden, G. Efficient resolution of replicated poxvirus telomeres to native hairpin structures requires two inverted symmetrical copies of a core target DNA sequence. Journal of virology 61, 1957-1963 (1987).

31. Merchlinsky, M., Garon, C. F. & Moss, B. Molecular cloning and sequence of the concatemer junction from vaccinia virus replicative DNA. Viral nuclease cleavage sites in cruciform structures. Journal of molecular biology 199, 399-413 (1988).

32. Merchlinsky, M. & Moss, B. Resolution of linear minichromosomes with hairpin ends from circular plasmids containing vaccinia virus concatemer junctions. Cell 45, 879-884 (1986).

33. Wussow, F. et al. Exploiting 2A peptides to elicit potent neutralizing antibodies by a multi-subunit herpesvirus glycoprotein complex. Journal of virological methods 251, 30-37 (2018).

34. Scheiflinger, F., Dorner, F. & Falkner, F. G. Construction of chimeric vaccinia viruses by molecular cloning and packaging. Proceedings of the National Academy of Sciences of the United States of America 89, 9977-9981 (1992).

35. Taylor, J., Weinberg, R., Kawaoka, Y., Webster, R. G. & Paoletti, E. Protective immunity against avian influenza induced by a fowlpox virus recombinant. Vaccine 6, 504-508 (1988).

36. Mayr, A. & Malicki, K. [Attenuation of virulent fowl pox virus in tissue culture and characteristics of the attenuated virus]. Zentralblatt fur Veterinarmedizin. Reihe B. Journal of veterinary medicine. Series B 13, 1-13 (1966).

37. Tscharke, D. C. et al. Identification of poxvirus CD8+ T cell determinants to enable rational design and characterization of smallpox vaccines. The Journal of experimental medicine 201, 95-104 (2005).

38. Wyatt, L. S. et al. Elucidating and minimizing the loss by recombinant vaccinia virus of human immunodeficiency virus gene expression resulting from spontaneous mutations and positive selection. Journal of virology 83, 7176-7184 (2009).

39. Wyatt, L. S., Shors, S. T., Murphy, B. R. & Moss, B. Development of a replication-deficient recombinant vaccinia virus vaccine effective against parainfluenza virus 3 infection in an animal model. Vaccine 14, 1451-1458 (1996).

40. Wang, Z. et al. Modified H5 promoter improves stability of insert genes while maintaining immunogenicity during extended passage of genetically engineered MVA vaccines. Vaccine 28, 1547-1557 (2010).

41. Jaume, M. et al. Anti-severe acute respiratory syndrome coronavirus spike antibodies trigger infection of human immune cells via a pH- and cysteine protease-independent FcgammaR pathway. J. Virol. 85, 10582-10597 (2011).

42. Noyce, R. S., Lederman, S. & Evans, D. H. Construction of an infectious horsepox virus vaccine from chemically synthesized DNA fragments. PloS one 13, e0188453 (2018).

43. Wyatt, L. S., Earl, P. L. & Moss, B. Generation of Recombinant Vaccinia Viruses. Current protocols in protein science 89, 5 13 11-15 13 18 (2017).

44. Iwasaki, A. & Yang, Y. The potential danger of suboptimal antibody responses in COVID-19. Nature reviews. Immunology 20, 339-341 (2020).

45. Graham, B. S. Rapid COVID-19 vaccine development. Science 368, 945-946 (2020).

46. Crawford, K. H. D. et al. Protocol and Reagents for Pseudotyping Lentiviral Particles with SARS-CoV-2 Spike Protein for Neutralization Assays. Viruses 12 (2020).

47. Wang, Z. et al. Recombinant modified vaccinia virus Ankara expressing a soluble form of glycoprotein B causes durable immunity and neutralizing antibodies against multiple strains of human cytomegalovirus. J. Virol. 78, 3965-3976 (2004).

48. Tischer, B. K., von Einem, J., Kaufer, B. & Osterrieder, N. Two-step red-mediated recombination for versatile high-efficiency markerless DNA manipulation in *Escherichia coli*. Biotechniques 40, 191-197 (2006).

49. Tischer, B. K., Smith, G. A. & Osterrieder, N. En passant mutagenesis: a two step markerless red recombination system. Methods Mol. Biol. 634, 421-430 (2010).

50. Birnboim, H. C. & Doly, J. A rapid alkaline extraction procedure for screening recombinant plasmid DNA. Nucleic acids research 7, 1513-1523 (1979).

51. Earl, P. L., Moss, B., Wyatt, L. S. & Carroll, M. W. Generation of Recombinant Vaccinia Viruses. Current Protocols in Molecular Biology 43, 16.17.11-16.17.19 (1998).

52. Millet, J. K. et al. Production of Pseudotyped Particles to Study Highly Pathogenic Coronaviruses in a Biosafety Level 2 Setting. J Vis Exp (2019).

53. Rogers, T. F. et al. Isolation of potent SARS-CoV-2 neutralizing antibodies and protection from disease in a small animal model. Science 369, 956-963 (2020).

F1 comprises a first partial sequence of the full-length sMVA genome and the first DNA sequence encoding the SARS-COV-2 N protein;

F2 comprises a second partial sequence of the full-length sMVA genome; and

F3 comprises a third partial sequence of the full-length sMVA genome and the second DNA sequence encoding SARS-COV-2 S protein;

and wherein an MVA terminal hairpin loop (HL) sequence flanked by MVA concatemeric resolution (CR) sequences (CR/HL/CR) is added to both ends of each of F1, F2, and F3.

2. The vaccine composition of claim 1, wherein the full-length sMVA genome comprises a nucleotide sequence identical to or having over 99% sequence identity to MVA strain Antoine (Accession No. U94848, SEQ ID NO: 91).

3. The vaccine composition of claim 1, wherein the full length sMVA genome comprises a nucleotide sequence identical to or having over 99% sequence identity to MVA strain Acambis (Accession No. AY603355, SEQ ID NO: 92).

4. The vaccine composition of claim 1, wherein the first insertion site is selected from the group consisting of Del2, Del3, intergenic region (IGR) between open reading frame (ORF) 44L and 45L (IGR 44/45), intergenic region (IGR) between open reading frame (ORF) 64L and 65L (IGR 64/65), intergenic region (IGR) between open reading frame (ORF) 69R and 70L (IGR69/70), and Thymidine Kinase (TK) gene insertion site, wherein the open reading frame numbers are based on MVA strain Antoine (Accession No. U94848).

5. The vaccine composition of claim 4, wherein the first insertion site is Del2.

---

SEQUENCE LISTING (92 sequences)

SEQ ID NO: 1 - DNA, 171907 bp, synthetic construct
  misc_feature 1..171907: note = sMVA-N/S
  source 1..171907: mol_type = other DNA
ttttatgagaccatcaaagagagaaagagaataaaaatattttttatgagaccatcaaagagagaaagagaataaaaatattttatgagaccatcaaagagagaaagagaataaaaatattttttatgagaccatcaaagagagaaagagaataaaaatattttatgagaccatcaaagagagaaagagaataaaaatattttttatgagaccatcaaagagagaaagagaataaaaatatttttgtatgagaccatcagaaagaggtttaatatttttgtgataccctgaaaggaaataggaatagtgtcataatcgtatcacactattgagacagaaaaagaagaagtcgcgagaggtaactttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttccatcagcggattctgagatggatttaatctgaggacatttggtgaatccaaagttcattctcagacctccaccgatgatggagtaataagtggtaggaggatctacatcctcgactgattccacctcgggatctggatctgactcggactctgtaatttccgttacggattggcaaatcttatcatcggtcggtgtttggtcttgctttgtgactttgataataacatcgattcccatatgatgtttgttttcttcttccgtacacgatgaggatgattgctgaagactggcaggcacatgcatgccagtacgatatattgtttcatgattgctattgattgagtactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctacattacccacatgataagagattgtatcagtttcgtagtcttgagtattggtattactatatagtatatagatgtcgacgctagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaagacgggatcgcagtctttatgattcatagtaatagttagttccgacgttgagatggattcgctgagaccggtagtggtcgtccgagtacacgatgtgtcgttaactggatacaggttaatttccacatcgatatagttaaaggtatttctgggtacgggttcgcatttatctgcggaagagacggtgtgagaatatgttccgagaccacacggagaacagatgacgtctccggatactccgtatcctattccacattttgtttgggaaacacatgccttgcatccatgatcgggagagcattcacagattctattgtgagtcgtgttacacgatcgcgtcgacattgttgacagaaacgtgaccttcattcttaccgtcgtccataaatacgttaggtatgtaccacatactgtcgcgaacgatgcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgccatggaaacaggacattatcactccatgataaattatttaatggagtcgatcctctcattgttctttgcgtatctcaatctgtggcgtttgcttcgtttaaataatatatcaaacatggagacgcctgatatgtaggcattcttcattctattaatgtctgctctatagcgctttagttccttatgacgaccggcgatatcatacttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactagcttctctttggtaactgcttttctggatggccgtattgattatcgagcgtgacactcgctccatattccaataaccgctttgcaaattgtatattattgacatcgaccgcgtaatatagtagagttatcgatcatatctatatcatccatgtacttgcttagtatatcaaatacatcttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagttgttgtccgtcgtcttatccaacatgcattgaatgataggtatacttaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataatctctatatctatggttgagcaagaccagtagtattggatggaaacattgttatcgatcaaacatttaattacatccttggatagagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgaaatcatttatattcgacttgagttcgttagaggaattcgaatagctggatatcagtagatgcacaatctgagattttacgtatctatgcttactgtatgctcctagcggagttaatccttcgttgtttctacaaagtctctcgactccgcgagagagtaacagtcgaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatacatgtgcaatccatagctattctggtgctaattattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctaaatttcagtttatgtttgtaccccgtattcatacttaacaaattggtattacataccattaataatgcaagcataaaaaatcgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacaaaatccatcaaaaatgttgataaattatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattattacgtgttgtctattatctgtttataggttcactcgacgaactaaactacctatacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccgtttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggccttgtatacataataataagttgtggtagtatgatctccatatttataatttaggactttgtattcagtttttttggaatcataaaaaataaaaaaaagttttactaatttaaaattatttacatttttttcactgtttagtcgcggatatggaattcgatcctgccaaaatcaatacatcatctatagatcatgtaacaatattacaatacatagatgaaccaaatgatataagactaacagtatgcattatcacaaaaataaatccacatttggctaatcaatttcgggcttggaaaaaacgtatcgccggaagggactatatgactaacttatctagagatacaggaatacaacaatcaaaacttactgaaactgtcaaaaaaatagaaacatatatggtctatatatacactacaatttagttattaattggataaccgatgtgattatcaatcaatattaagaaggttggtaaattggtacatagctaataatacctatacacccaataatacaacaaccatttctgagttggatatcatcaaaatactggataaatacgaggacgtgtatagagtaagtaaagaaaaagaatgtgaaatttgctatgaagttgtttactcaaaacgatagatactttggtttattggattcgtgtaatcatatattttgcataacatgcatcaatatatggcatagaacacgaagagaaaccggtgcgtcggataattgtcctatatgtcgtacccgttttagaaacataacaatgagcaagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacgcactacttcagccaaatattcttttttgaaacgccatctatcgtagtgaggacacaagtgaacctataatgagcaaatttattagtatcggttacatgaaggactttacgtagagtggtgattccactatctgtggtacgaacggtttcatcttctttgatgccatcacccagatgttctataaacttggtatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattttcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattgacatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgcggctttccattttccaaaaacaatttgaccaaatctacatctttattgtatctataatcactatttagataatcagccataattactcgagtgcaacatgttagatcgtctatatatgaataagccgtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataatttcaggaacaggatcatctgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatgataaagtatactacatccatgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaattgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgagtatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctcgttttgttagatgtttgcatcgtgctttaacatcaatggtacaaattttatcctcgctttgtgtatcatattcgtccctactataaaattgtatattcagattatcatgagatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttatcaaatggttgataatatggatcctcatgacaatttccgaagatggaaatgagatatagacatgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaagagttcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataacacacatgtcttaaagtttattaattaattacatgttgttttatatatcgctacgaatttaaacagagaaatcagtttaggaaaaaaaaatatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctctatatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagattaatggtgtgatgttgattaggtcttttacgaatttgatatagaatagcgtttacatattctccataatggtcaatcgccatttgttcgtatgtcataaattctttaattatatgacactgtgtattatttagttcatccttgttcatcattaggaatctatccaatatggcaattatactagaactataggtgcgttgtatacacatattgatgtgtctgtttatacaatccatgctactaccttcgggtaaaattgtagcatcatataccatttctagtactttaggttcattgttatccattgcagaggacgtcatgaacgcatcctaaaaaaatatattatttttatgttattttgttaaaaataatcatcgaatacgaactagtataaaaaggcgcgccttaggcctgagttgagtcagcactgctcatggattgttgcaattgtttggagaaatcatccaaatctgcagcaggaagaagagtcacagtttgctgtttcttctgtctctgcggtaaggcttgagtttcatcagccttcttcttcttgtccttcttaggctctgttggtgggaatgtcttgtatgcgtcaatatgcttattcagcaatatgacttgatctttgaaatttggatctttgtcatccaatttgatggcacctgtgtaggtcaaccacgttcccgaaggtgtgacttccatgccaatgcgcgacattccgaagaacgctgaagcgctgggagcaaattgtgcaatttgcggccaatgtttgtaatcagttccttgtctgattagttcctggtctccaaagtttccttgggtttgttctggaccacgtctgccgaaagcttgtgttacattgtatgctttagtggcagtacgtttctgccgaggcttcttagaagcctcagcagcagatttcttagtgacagtttggccttgttgttgttggcctttaccagacatcttgctctcaagctggttcaatctgtcaagcagcagcaaagcaagagcagcatcaccgccattgccagccattctagcaggagaagttcctctactgctgcctggagttgaatttcttgaactgttgcgactacgtgatgaggaacgagaagaggcttgactgccgcctctgctcccttctgcgtagaagcctttaggcaatgttgttccttgaggaagttgtagcacgattgcagcattgttagcaggattgcgggtgccaatgtgatctttaggtgtattcaaggctccctcagttgcaacccatatgatgccgtctttgttagcaccatagggaagtccagcttctggcccagttcctaggtagtagaaataccatcttggactgagatctttcatcttaccgtcaccaccacgaattcgtctggtagctcttcggtagtagccaatttggtcatctggactgctattggtgttaattggaacgccttgtcctcgagggaatttaaggtcttccttgccatgttgagtgagagcggtgaaccaagacgcagtattattgggtaaaccttgaggccgacgttgtttagatcgcgctccactgcgttctccattctggttactgccagttgaatctgagggtccaccaaacgtaatgcgtggtgcgtttcgctgattctgtggtccgttatcagacatggtggcggcgtttatcttatttatgattatttctcgctttcaatttaacacaaccctcaagaacctttgtatttattttcaatttttgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgcatctttgctagagagaaagcttttcagctgcttagacttccaagtattaattcgtgacagatccatgtctgaaacgagacgctaattagtgtataatttttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattctaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggtagacgctgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcgcccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttctaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatctcattgtttgttccctggagtatgagagtcggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttatgaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaggataaagtttatacaagtgtagatgataaattctacagaggttaatatagaagcacgtaataaattgacgacgttatgactatctatatatacctttccagtatatgagtaaataactatagaagttagactgtgaatgtcaaggtctagacaaaccctcgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctaaagaaaaatgattatcttcttgagacataactcccattttttggtattcacccacacgtttttcgaaaaaattagttttaccttctaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggataccgcatctgttataatagatctaacggtttcttcactcggtggatgcaataaatgtttaaacatcaaacatgcgaagtcgcagtgtagaccctcgtctctactaatcaattcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggatcttttgtacatcgatatcgccgcaatcactacaataattacaagtattattgatagcattgttattagtactatcataattaaattatcgttattatcattttgtaattgtgacatcatactagataaatcgtttgcgagattgttgtgggaagcgggcatggaggatgaattatcgttattattatttaaagcctcccattcggattcacaaatatggcgcgcgttcaacattttatggaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatacgattagtaatgaccattaaaataaaaatattcttcataaccggcaagaaagtgaaaagttcacattgaaactatgtcagtagtatacatcatgaaatgatgatatatatatactctattttggtggaggattatatgatataattcgtggataatcattcttaagacacatttcttcattcgtaaatcttttcacgttaaatgagtgtccatattttgcaatttcttcatatgatggcggtgtacgtggacgaggctgctcctgttcttgttgtagtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatccaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctagctcggtatctactttatctgccgaatacagtgctaggggaaaaattataatatttcctctttcgtattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgatagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgatggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttggtaatgaaattattcacaatatcagtatcttctttatctaccagagattttactaacttgataaccttggctgtctcattcaatagggtagtaatatttgtatgtgtgatattgatatcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggttatgttatatgtaacattgagtaaatccttaagttcataatcatcactgtcatcagttatgtacgatccaaacaatgtttctactggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgtaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtataaaacaacgaaattatactagagttgttaaagttaatattttctatgagctgttccaataaattatttgttgtaactgcgttcaagtcataaatcatcttgatactatccagtaaaccgtttttaagttctggaatattattatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagagaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccggatacgtggatatcatatatggtattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctataatcgttaaattttacaaatctataacatgctaaaccttttgacgacaaccattcattaatttctgatatggaatctgtattctcaataccgtatcgttctaaagccagtgctatatctccctgttcgtgagaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatattgtaatattcatcatcgacataacactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctatacgtttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagccgacttgagtttatcaataactacatcagtgtctagatctctagaatatcccaataggtgttccggagaatcagtaaagaacactccacctataggattcttaatatgatacgcagtgctaactggcagacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcattatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccggtgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatcattttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattacatgttttcatattcattaggattattaaatctttaatcttactacgattgtatgcgttgatattgcaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgttttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaaaatacaattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtaataaattttattagaaatgccaaatctataagaaaagtcctcgaattagtttgaagaatatctatatcgccgtaccgtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctcaacacaaactttttcacagagcgatagagtttttgataactcgtttttcttaagaaatataaaactactgtctccagagctcgctctatcttttattttatttaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttggttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtatttcgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatatctacacaggcataaaatgtaggagagttactaggccccactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactaatttattttatcatttttttattcatcatcctctggtggttcgtcgtttctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaatttcataatgagtggaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggaaaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatagtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattacctgcatcttattagaatattaacctaactaaaagacataacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattcccgtatatgaagaaaaagtaaatactgaattcattgctaatggatcgttctctggtagatacgtatcatatcttcgaaagttttctgcccttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacatgatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtaactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagtcagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtaactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaatcttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacagcaatttctttattctctacagatgtaagatacttgaagacattcctatgatgatgcagaattttggataacacggtattgatggtatctgttaccataattcctttgatggctgatagtgtcagagcacaagatttccaatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctacaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattcctttttgcctgtatcatccagttttccatcctttgtaaagaaattattttctactagactattaataagactgataaggattcctccataattgcacaatccaaactttttaacaaaactagactttacaagatctacaggaatgcgtaattcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatattttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcttttatttccacattagatggtaaatccaatagtgaaactatctttttaggaatgtatggactcgcgtttagaggagtgaacgtcttaggcgtcggaaaggatgattcatcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatctggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtttgtgattcgtgttaaaaccatcggagaaggaataaaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggcggtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaagaatttatttctaaatctatgagagatcaacgaaaaggaagagtaggaagagttaatcctgggacatacgtatatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtatctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagagaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgccaattaatgtatgcattagaaccacgcaaggagattgatgtttcagaagttaaaactttatcatcttatatagatttcgaaaatactaaatcagatatcgatgttataaaatctatatcttcgatcttcggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacgtgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgaatgttataaaaatgccggtattgatacatcgtctaaacgaatattaggtaaagatatttttctgagccaaaacttcacagatgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcactgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatgacgtttttagattaatactttcaatgagataaatatgggtggcagagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtaccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatttcacaactttactgtttttaaactgttcaaaatatagcatcgatccatgagaaatacgtttagccgcctttaatagaggaaatcccaccgcctttctggatctcaccaacgacgatagttctgaccagcaacttatttcttcatcatccacctgttttaacatataataggcaggagatagatatccgtcattgcaatattccttttcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgagaatatcacaggggcaatgtttaccacaatgtataatataagaaacaatttgggtctaggagatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcattgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaatcagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctaccgtcctaatataccattaaaaattgttagatttttccgcaataacatggtaactggagtagagatagccgatagatctgttatttcagtcgctgattaatcaattagtagagatgagataagaacattataataatcaataatatattttatatcttatatcttgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattattttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaattatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacacttccagtatcaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgtcaactctcaaaatgctgatttcgacggagatgaagaatggatgatattggagcaaaatcctaaagccgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagtcttaccttactatcttccagactctaaggatccagaaggaagaggttacattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataggtatgtagtagatataatagtcaatagattatacatcaagagagcagaaattaccgaattagtcgtcgaatatatgattgaacgattcatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggcaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttactcttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcattgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcgatttctatttttagatgtgatggaaaaatgactaattttgtagcattagtatcatgaactctaatcgagatcttaatatcttcgtcacacgttagttctttgaagtttttaagagatgcatcagttggttcgaccgatggagtaggtgcaacaattttttgttcgatgtatgtatgtactggagccattgtcttaactataatggtgcttgtatcgaaaaactttaatgcagataatggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatttcatataagaaactataaagtccgcactactgttaagaatgattactaacgcaactatatagtttaaattaagcatcttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtatgatgactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgagataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaaacacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacaatatggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttattacacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcgcctataaaaacctttatgttgcctaaacaagatatagtaggtttggatctggaaaatctatatgccgtaactaagactgacggaattcctataactatcagagttacatcaaaagggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgcggacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagatcaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctgaagatatgcacactgataaatttgtcatttatgatatttatacgtttgattcgttcaagaataaacgattggtatttgtacaggtgcctccatcattaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattctgtcaataagacatcaactacctaaggaatattcaagcgaattactctgtccgaggaaacgaaagactgtagaagctaacatacgagacatgttaatagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagttgtacgaaaaaactttatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtctttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacaaaaaatatcatgttcctattatgaaactatatcctacaccggaagagattccggactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatattaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgaggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagactaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggagccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgttgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggtggatctaatggaatccaattgattaactatcttttgaaaatatacatttttatgatccgatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatacgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcattccaagcgatattatctcaacaaaattcagattctatctttagagtatccactaaactattacggtttatgtactacaatgaactaagagaaatctttagacggttgagaaaaggttctatcaacgatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgtccaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctttaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattaacgataggtgtagccgataaacaaatcatcttatggttttttaatgcgatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccaacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgtgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctaaagacaagttaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattggccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaatacccaacttcaccacccttgaatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaatacagactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcttcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgattatttcctgcacgtttaggtttggtacgttgatttctagcccctgcggatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatattcaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggcgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagccggtgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccatataccaaactttcagaagaaatggtgtacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatacaatatcttcggtatcttgacgcaatctagtatacatagagttaagagaaattagagtttgtacattaagcaacatgtctctaaatgtggctgcaaacttttccttttccacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttctcaacgtcgatttgatgaacacacgatgaaaatgtacttcgatgagattgatcatgtagaaaacaacaagggatacaatatttccacatatcatgaaatatattaagaaatcccaccttattatatttccccaaaggatccatgcatgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcatacgatccaaattccggaatagatgtatcgcacgctctggccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcatcaacgagttaaaaaagaccagttcattcaagataagcaaacgcgataaggatacgctactaaaatattttacttaggactggagttagaatttatagacgactcatttcgtttatcattattagtattcttcttgttatcttgttcagaaatatacagcaatgctatgcctaatactaaatacattatcatgcttgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccattttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatttccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcctgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgccacggttacattcactgcagcattttgaggatcgcgagtatgaagtacgatgttattgtttactggtatatctggaaagaattctaccagtctaggaataagagattgatatcgcatagaaatacaaaagttcataatctcatcatctaagagcattttgttaccattgtaataaatatccactctgtcatatgtataaatgaagtactgttcaaacatgatgagatgtttatatgttggcatagtagtgagatctacgtttggtaatggcaatgtattaagattaactccataatgtctagcagcatctgcgatgttataagcgttgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattctccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgatatcttctatgccaacacaaacaccatccttgggagtagtttatgataaagataaaagaattcagatgttggaggatgaagtggttaatcttagaaatcaacgatctaatacaaaatcatctgataatttagataattttaccagaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaatattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtaggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggatttggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataatttagttcatggaaatatcgctatgattggtatgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatatccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacccgatgaatcggacaatgtactgggccatgtagaataaattatcaacgaattatcgtctacgaacatttatatcatttgttttaattttagtacgcgaataaatagatataaaatagaaaataacagatattacaaccaatgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacggctgcccccatttttaataatcgtcagtatttaaactgttaaatgttggtatatcaacatttaccttatttcccgcagtataaggtttgttgcaggtatactgttcaggaatggttacatttatactttttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtatttgaaacattaacaacgaccgataataaaattactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcagtagatagtttttttgagccatattccacagataatattagacatatgataaaacgattagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattcttctacaaacgattattagattttttcggatcagaggttgtatttataggagacgcccaaaatagacgtactccagatatggtcaaatcaatcaaggaactaaatagatttatattcgtatccaccttattttattccggtactggtttagatattcctagtttggattctttgttcatttgctcggcagtaatcaacaatatgcaaatagagcaattactagggagggtatgtcgagaaacagaactattagataggacggtatatgtatttcctagcacatccatcaaagaaataaagtacatgataggaaatttcgttcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatctttattattattgacctcgtttatcttggaacatggaatgggaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgaaattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgagactatatatggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcacatagctaaagatttgtcacaatatgaatacactacagttcttctagaacgtcagcctagaaggtcgccgtacgtcaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattatggggaaataaagaaaactgtacatggaggcactaatgcaaattacttttccggtaaaaagtctgatgagtatctgagcactacagtcaggtccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaaacactaattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcctggacttaatcatgcattttctagtctattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccgttggaaaactttaataacaaagaaagagataggtctaacgcctattcaaaattagaaagtaatggattagttagactgaatgctttcttggaatccggagacgctatagcacgaaatatctcatcaagaactcttgaagatgattttgctagagataatcagattagctttgatgtttccgaaaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatatcgcggatgaaacggaacttccatacgatgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaaaccgtcttttctggtgtaatattctagtttggtagtagatacatatcaatatcatcaaattcgagatccgaattataaaatgggcgtggattgttaactatagaatcggacgtctgatattcgaaaatctgtggagttttaggttttggtggaggtgtaactgctacttgggatactgaagtctgatattcagaaagctgggggatgttctggttcgacatccaccgatggtgtcacatcactaatcggttcggtaacgtctgtggacgatggaggcaccacttctacaggttctggttctttatcctcagtcatcaacggagctacttcaatgcgaggaaatgtataatttggtaatggtttctcatgtggatctgaagaagaggtaagatatctactagaaagataccgatcacgttctagttctcttttgtagaacttaactttttctttctccgcatctagttgatattccaacctcttcacgttcgcatgggttacctccgcagtttttacgagcgatttcacgttcagccttcatgcgtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgatcattaataagatttttatcattgctcgttatttcagaatcgtatatataaggagtaccatcgtgattcttaccagatattatacaaaatactatatataaaatatattgacccacgttagtaatcatgtaaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagccgttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtagctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggaacaatttacaaattgggatcgtctatcgatagactttctctaaataggactattgttacaaaagttaataattataattatgatacattttttgacgatgatgattgatcgctattgcacaattttgtttttttactttctaatatagcgtttagattctttttcatgtgcgaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctggattataaacgggtgtaaacaagaatacatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacagagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttaaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggtcgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactgtatgtaaacaatctatcactgattaattattcgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgatgatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccgcacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatgcatgcaaagctctaaatccaaattcggatctaattaagatagagactccaaacgagttaagttttttaagaagcattagacgcggatattgggtaggagaatccgaaatattaaaccagacaaccccatataattttatagctaaaaatgccacgaagaatggaactaaaaaacggaaatatatttgtagtacaacgaatactcccaaactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttatattttgtagtaagaatagaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcagcatttcctacatatacccggctatgtaccgcgttatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaatatagtctgtgttccataatagtttactttcatgatttcattatcggtgtattttccaaatacatccactagagcagctgtatgaataatcagatttaccccatctagcgcttctcttaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcgggcacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaatgaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctctaaaggatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaacaagtttatgagcttttataaggataacctagaaaatatagtagatgctatcattactctaaaatatataatgaataatccagattttaaaactacgtatgccgaagtactcggttccagaatagcggatatagatattaaacaagtgatacgtgagaatatactacaattgtctaataatatccgcgaacgatatttgtgaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatatcgcatccgtttgtacatgtaatgatttaaaatgtgtagtcatgcttattgataaagatctaaaaattaaagcgggccctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccaaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaattaaaataacactatttagttggtggtcgccatggatggtgttattgtatactgtctaaacgcgttagtaaaacatggcgaggaaataaatcatataaaaaatgatttcatgattaaaccatgttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcaatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaaaaaattgaaaataaatacaaaggttcttgagggttgtgttaaattgaaagcgagaaataatcataaataagataaacgccgccaccatgtttgtctttcttgtcttattgccactagtctctagtcagtgtgttaatcttacaaccagaactcaattaccacctgcatacactaattctttcacacgtggtgtttattaccctgacaaagtattcagatcctcagtattacattcaactcaggacttgttcttacctttcttctccaatgttacttggttccatgctatacatgtctctgggaccaatggtactaagaggtttgataaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaatgatccattcttgggtgtttattaccacaagaacaacaagagttggatggaaagtgagttcagagtttattctagtgcgaataattgcactttcgaatatgtctctcagcctttccttatggaccttgaaggtaaacagggtaatttcaagaatcttagggaatttgtgtttaagaatattgatggttatttcaagatatattctaagcacacgcctattaatttagtgcgtgatctccctcagggtttctcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttgaaggatttaattgttactttcctttacaatcatatggtttccaacccactaatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgctgacactactgatgctgtccgtgatccacagacacttgagattcttgacattacaccatgttcatttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtatttcaaacacgtgcaggctgtttaataggagctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagagaattcagttgcttactctaataactctattgccatacccacaaactttactattagtgttaccacagaaattctaccagtgtctatgaccaagacatcagtagattgtacaatgtacatttgtggtgattcaactgaatgcagcaatctattgttgcaatatggcagtttctgtacacaattaaaccgtgctttaactggaatagctgttgaacaagacaagaacacccaagaagtatttgcacaagtcaaacaaatttacaagacaccaccaattaaagatttcggtggatttaatttctcacaaatattaccagatccatctaaaccaagcaagaggtcatttattgaagatctactattcaacaaagtgacacttgcagatgctggcttcatcaaacaatatggtgattgccttggtgatattgctgctagagacctcatttgtgcacagaagtttaacggccttactgtattgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccagaaattgattgccaaccaatttaatagtgctattggcaagattcaagactcactttcttccacagcaagtgcacttggtaaacttcaagatgtggtcaaccagaatgcacaagctttaaacacgcttgttaaacaacttagctccaactttggtgcaatttcaagtgtattaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaagatgtcagagtgtgtacttggacaatctaagagagttgatttctgtggaaagggctatcatcttatgtccttccctcagtcagcacctcatggtgtagtcttcttgcatgtgacttatgtccctgcacaagagaagaacttcacaactgctcctgccatttgtcatgatggtaaagcacactttcctcgtgaaggtgtctttgtttcaaatggcacacactggtttgtaacacaaaggaatttctatgaaccacaaatcattactacagacaacacatttgtgtctggtaactgtgatgttgtaataggaattgtcaacaacacagtttatgatcctttgcaacctgaattagactcattcaaggaggagttagataaatatttcaagaatcatacatcaccagatgttgatttaggtgacatctctggcattaatgcttcagttgtaaacattcagaaagaaattgaccgcctcaatgaggttgccaagaatttaaatgaatctctcatcgatctccaagaacttggaaagtatgagcagtatatcaaatggccatggtacatttggctaggtttcatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataaggcgcgcctttttatactagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactttatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagttacagacactgtctcatacactacagtaagtacatcatctggaattgtcactactaaatcaaccaccgatgatgcggatctttatgatacgtacaatgataatgatacagtaccatcaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaacatactgagtttttaggaaatatttacggaacttctaaaactgctgtgaatacagcggctattaataatcgtatttgtgtgatggatctaaacatcgacggtgttagaagttttaaaaatacttacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggttgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcacatatcgccacaaaaactactatgctctaagcggaatcgggtacgagagtctagacttgtgtttggaaggagtagggattcatcatcacgtacttgaaacagaaaacgctgtatatggaaaagttcaacatgattattctactatcaaagagaaggccaaagaaatgaatgcactcagttcaggacctatcatcgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaaccacctctctggaagacagtgtgaatcatgtactcatgaaacgtttggaatctatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatgagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaatctattaatgttaaacatacatctgtttcagctaagcaactaagaacacgtatactctcatcttttgccaacacagagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacacgtgtcgattcatcaaggtatataaacctggggatgaggctacctcgacatacgtgtgcgctatcaaagtggaaagatgctgttgtgctgtgtttgcagattggccagaatcatggtatcaagaagtattctccagatgaataggtgtcacatataaaattttaattaatgtaactatagagaacaaataataggttgtaatatcatatagacaataactaacaattaattagtaactgttatctctttttaactaactaactatacctattaatacatcgtaattatagttcttaacatctattaatcattgattcgcttctttaattttttataaaccaacattgttaattgaaaagggataacatgttacagaatataaattatatatggattttttttaaaaaggaaatacttgactggagtgtatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttatatagatgccgaagacagttacggttgtacattattacatagatgtatatatcactataagaaatcagaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacaatcactacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaagtgcactagtctcgacgtatacggaagtcgtgtacgtaatatcatagcatctattagatatcgtcagagattaattagtctattatccaagaagctggatcctggagataaatggtcgtgttttcctaacgaaataaaatataacgataacgaactgtccacatatctaaaaatcttataaacactattaaaatataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacgtttacatgtgatcagggatatcattcttcggatccaaatgctgtctgcgaaacagataaatggaaatacgaaaatccatgcaaaaaaatgtgcacagtttctgattacatctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtgaatataaatccgttaaaataatgaataattaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggaccaccgactgtaacattaactgaatacgacgaccatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtctccccgctataaaggcattatcaacttctccttattgattgaaaatgaaaatataaatagtttttatgtatagcagtattaccctatagttttattgcttactactaacatggatacagatacagatgttacaaatgtagaagatatcatgaatgaaatagatagagagaaagaagaaatactaaaaaatgtagaaattgaaaataataaaaacattaacaagaatcatcccaatgaatatattagagaagcactcgttattaatacaagtagtaatagtgattccattgataaagaagttatagaatgtatcagtcacgatgtaggaatatagatcatatctactaatttttataatcaatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaatttgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtagactgtttatacaagattgaaatattctttttttatagagtgtggtagtgttacggatatctaatattaatattagactatctctatcgcgctacacgaccaatatcgattactatggatatcttctatgaaaggagagaatgtattcatttctccagcgtcaatctcgtcagtattgacaatactgtattatggagctaatggatccactgctgaacagctatcaaaatatgtagaaaaggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaacaattgtctcctagcaattagtgccgtatactttaaagcaaaatggttgacgccattcgaaaaggaatttaccagtgattatcccttttacgtatcaccaacggaaatggtagacgtaagtatgatgtctatgtacggcgagctatttaatcacgcatctgtaaaagaatcattcggtaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaatttttttcgttggtagatattgctctccgacaactaattgttaaccattttttttaaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtgtagaaatcatccgttgttatataccggatgagcaaaaaaccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctccctttcccagaaacaaactttttttacccactataaaataaaatgagtatactacctgttatatttctttctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcgggcatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagaaggtgttgtaacttcaataggtagtaatttgactattgcgtgtagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttaatatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatatagatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacaatagacacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataatgaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaaaaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagtggaagatacaactgttacgttcattacgacgacgttagaatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctataacgcgactatctaggtatttgtatctcaccgatagagaacatataaatgtagactctattaaacagttgtgtaaaatatcagatcctaatagatgtggatgtacggctttagaaatgagttcattaaaatatgtgatatcaacggaacatatttatataattatactattgctgttagtataattattgattccacggaagaactaccaacagttactccaattacaacaacatataattatactatcgatgatagcactactgaagaactacaagtgactcctcatatggatctccatcgatgatacatgtattaaaatactttccgaataagtcttttaaatattgtattaattatgaaaaactatgctatgcgagtatgatacgatactagattttatctctagcgagagatgtcgttagaatcatttatcaacgaatatcgataacatgtgtcatttatacgttaaagtctgtccgtcttctctattgtttagactgtttgtagaatgctgtgatataaacaaactagtagacacaaatatttaactcatgatgaagttgagaatgatatgctttagctaatataaaaatatattaatccactatatattctagacttgatttaaaaccgataaactactactacgtactgtataagttaggagcagaccctaattatgtagatgatagaggtaatacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtggagatcattaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttcgactgttactctctcgcggagtcgagagactttgtagaaacaacgaaggattaactccgctaggagcatacagtaagcatagatacgtaaaatctcagattgtgcatctactgatatccagctattcgaattcctctaacgaactcaagtcgaatataaatgatttcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctctatccaaggatgtaattaaatgtttgatcgataacaatgtttccatccaatactactggtcttgctcaaccatagatatagagattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtaagtatacctatcattcaatgcatgttggataagacgacggacaacaactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaagatgtatttgatatactaagcaagtacatggatgatatagatatgatcgataactctactatattacgcggtcgatgtcaataatatacaatttgcaaagcggttattggaatatggagcgagtgtcacgctcgataatcaatacggccatccagaaaagcagttaccaaagagaagctagttgatttattactgagttaccatcccactctagagactatgattgacgcatttaatagagatatacgctatctatatcctgaaccattattcgcctgtatcagatacgccttaatcctagatgatgattttccttctaaagtaagtatgatatcgccggtcgtcataaggaactaaagcgctatagagcagacattaatagaatgaagaatgcctacatatcaggcgtctccatgtttgatatattatttaaacgaagcaaacgccacagattgagatacgcaaagaacaatgagaggatcgactccattaaataatttatcatggagtgataatgtcctgtttccatggcatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgcatcgttcgcgacagtatgtggtacatacctaacgtatttatggacgacggtaagaatgaaggtcacgtttctgtcaacaatgtcgacgcgatcgtgtaacacgactcacaatagaatctgtgaatgctctcccgatcatggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacctttaactatatcgatgtggaaattaacctgtatccagttaacgacacatcgtgtactcggacgaccactaccggtctcagcgaatccatctcaacgtcggaactaactattactatgaatcataaagactgcgatcccgtcttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagcgtcgacatctatatactatatagtaataccaatactcaagactacgaaactgatacaatctcttatcatgtgggtaatgtagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtactcaatcaatagcaatcatgaaacaatatatcgtactggcatgcatgtgcctgccagtcttcagcaatcatcctcatcgtgtacggaagaagaaaacaaacatcatatgggaatcgatgttattatcaaagtcacaaagcaagaccaaacaccgaccgatgataagatttgccaatccgtaacggaaattacagagtccgagtcagatccagatcccgaggtggaatcagtcgaggatgtagatcctcctaccacttattactccatcatcggtggaggtctgagaatgaactttggattcaccaaatgtcctcagattaaatccatctcagaatccgctgatggaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaagttacctctcgcgacttcttctttttctgtctcaatagtgtgatacgattatgacactattcctatttcctttcagggtatcacaaaaatattaaacctctttctgatggtctcatacaaaaatatttttattctctttctctctttgatggtctcataaaaaatatttttattctctttctctctttgatggtctcataaaatatttttattctctttctctctttgatggtctcataaaaaatatttttattctctttctctctttgatggtctcataaaatatttttattctctttctctctttgatggtctcataaaaaatatttttattctctttctctctttgatggtctcataaaa

SEQ ID NO: 2 - DNA, 171918 bp, synthetic construct
  source 1..171918: mol_type = other DNA
  misc_feature 1..171918: note = sMVA-S/N
ttttatgagaccatcaaagagagaaagagaataaaaatattttttatgagaccatcaaagagagaaagagaataaaaatattttatgagaccatcaaagagagaaagagaataaaaatattttttatgagaccatcaaagagagaaagagaataaaaatattttatgagaccatcaaagagagaaagagaataaaaatattttttatgagaccatcaaagagagaaagagaataaaaatatttttgtatgagaccatcagaaagaggtttaatatttttgtgataccctgaaaggaaataggaatagtgtcataatcgtatcacactattgagacagaaaaagaagaagtcgcgagaggtaactttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttccatcagcggattctgagatggatttaatctgaggacatttggtgaatccaaagttcattctcagacctccaccgatgatggagtaataagtggtaggaggatctacatcctcgactgattccacctcgggatctggatctgactcggactctgtaatttccgttacggattggcaaatcttatcatcggtcggtgtttggtcttgctttgtgactttgataataacatcgattcccatatgatgtttgttttcttcttccgtacacgatgaggatgattgctgaagactggcaggcacatgcatgccagtacgatatattgtttcatgattgctattgattgagtactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctacattacccacatgataagagattgtatcagtttcgtagtcttgagtattggtattactatatagtatatagatgtcgacgctagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaagacgggatcgcagtctttatgattcatagtaatagttagttccgacgttgagatggattcgctgagaccggtagtggtcgtccgagtacacgatgtgtcgttaactggatacaggttaatttccacatcgatatagttaaaggtatttctgggtacgggttcgcatttatctgcggaagagacggtgtgagaatatgttccgagaccacacggagaacagatgacgtctccggatactccgtatcctattccacattttgtttgggaaacacatgccttgcatccatgatcgggagagcattcacagattctattgtgagtcgtgttacacgatcgcgtcgacattgttgacagaaacgtgaccttcattcttaccgtcgtccataaatacgttaggtatgtaccacatactgtcgcgaacgatgcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgccatggaaacaggacattatcactccatgataaattatttaatggagtcgatcctctcattgttctttgcgtatctcaatctgtggcgtttgcttcgtttaaataatatatcaaacatggagacgcctgatatgtaggcattcttcattctattaatgtctgctctatagcgctttagttccttatgacgaccggcgatatcatacttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactagcttctctttggtaactgcttttctggatggccgtattgattatcgagcgtgacactcgctccatattccaataaccgctttgcaaattgtatattattgacatcgaccgcgtaatatagtagagttatcgatcatatctatatcatccatgtacttgcttagtatatcaaatacatcttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagttgttgtccgtcgtcttatccaacatgcattgaatgataggtatacttaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataatctctatatctatggttgagcaagaccagtagtattggatggaaacattgttatcgatcaaacatttaattacatccttggatagagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgaaatcatttatattcgacttgagttcgttagaggaattcgaatagctggatatcagtagatgcacaatctgagattttacgtatctatgcttactgtatgctcctagcggagttaatccttcgttgtttctacaaagtctctcgactccgcgagagagtaacagtcgaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatacatgtgcaatccatagctattctggtgctaattattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctaaatttcagtttatgtttgtaccccgtattcatacttaacaaattggtattacataccattaataatgcaagcataaaaaatcgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacaaaatccatcaaaaatgttgataaattatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattattacgtgttgtctattatctgtttataggttcactcgacgaactaaactacctatacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccgtttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggccttgtatacataataataagttgtggtagtatgatctccatatttataatttaggactttgtattcagtttttttggaatcataaaaaataaaaaaaagttttactaatttaaaattatttacatttttttcactgtttagtcgcggatatggaattcgatcctgccaaaatcaatacatcatctatagatcatgtaacaatattacaatacatagatgaaccaaatgatataagactaacagtatgcattatcacaaaaataaatccacatttggctaatcaatttcgggcttggaaaaaacgtatcgccggaagggactatatgactaacttatctagagatacaggaatacaacaatcaaaacttactgaaactgtcaaaaaaatagaaacatatatggtctatatatacactacaatttagttattaattggataaccgatgtgattatcaatcaatattaagaaggttggtaaattggtacatagctaataatacctatacacccaataatacaacaaccatttctgagttggatatcatcaaaatactggataaatacgaggacgtgtatagagtaagtaaagaaaaagaatgtgaaatttgctatgaagttgtttactcaaaacgatagatactttggtttattggattcgtgtaatcatatattttgcataacatgcatcaatatatggcatagaacacgaagagaaaccggtgcgtcggataattgtcctatatgtcgtacccgttttagaaacataacaatgagcaagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacgcactacttcagccaaatattcttttttgaaacgccatctatcgtagtgaggacacaagtgaacctataatgagcaaatttattagtatcggttacatgaaggactttacgtagagtggtgattccactatctgtggtacgaacggtttcatcttctttgatgccatcacccagatgttctataaacttggtatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattttcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattgacatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgcggctttccattttccaaaaacaatttgaccaaatctacatctttattgtatctataatcactatttagataatcagccataattactcgagtgcaacatgttagatcgtctatatatgaataagccgtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataatttcaggaacaggatcatctgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatgataaagtatactacatccatgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaattgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgagtatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctcgttttgttagatgtttgcatcgtgctttaacatcaatggtacaaattttatcctcgctttgtgtatcatattcgtccctactataaaattgtatattcagattatcatgagatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttatcaaatggttgataatatggatcctcatgacaatttccgaagatggaaatgagatatagacatgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaagagttcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataacacacatgtcttaaagtttattaattaattacatgttgttttatatatcgctacgaatttaaacagagaaatcagtttaggaaaaaaaaatatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctctatatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagattaatggtgtgatgttgattaggtcttttacgaatttgatatagaatagcgtttacatattctccataatggtcaatcgccatttgttcgtatgtcataaattctttaattatatgacactgtgtattatttagttcatccttgttcatcattaggaatctatccaatatggcaattatactagaactataggtgcgttgtatacacatattgatgtgtctgtttatacaatccatgctactaccttcgggtaaaattgtagcatcatataccatttctagtactttaggttcattgttatccattgcagaggacgtcatgaacgcatcctaaaaaaatatattatttttatgttattttgttaaaaataatcatcgaatacgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgcatctttgctagagagaaagcttttcagctgcttagacttccaagtattaattcgtgacagatccatgtctgaaacgagacgctaattagtgtataatttttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattctaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggtagacgctgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcgcccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttctaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatctcattgtttgttccctggagtatgagagtcggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttatgaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaggataaagtttatacaagtgtagatgataaattctacagaggttaatatagaagcacgtaataaattgacgacgttatgactatctatatatacctttccagtatatgagtaaataactatagaagttagactgtgaatgtcaaggtctagacaaaccctcgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctaaagaaaaatgattatcttcttgagacataactcccattttttggtattcacccacacgtttttcgaaaaaattagttttaccttctaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggataccgcatctgttataatagatctaacggtttcttcactcggtggatgcaataaatgtttaaacatcaaacatgcgaagtcgcagtgtagaccctcgtctctactaatcaattcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggatcttttgtacatcgatatcgccgcaatcactacaataattacaagtattattgatagcattgttattagtactatcataattaaattatcgttattatcattttgtaattgtgacatcatactagataaatcgtttgcgagattgttgtgggaagcgggcatggaggatgaattatcgttattattatttaaagcctcccattcggattcacaaatatggcgcgcgttcaacattttatggaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatacgattagtaatgaccattaaaataaaaatattcttcataaccggcaagaaagtgaaaagttcacattgaaactatgtcagtagtatacatcatgaaatgatgatatatatatactctattttggtggaggattatatgatataattcgtggataatcattcttaagacacatttcttcattcgtaaatcttttcacgttaaatgagtgtccatattttgcaatttcttcatatgatggcggtgtacgtggacgaggctgctcctgttcttgttgtagtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatccaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctagctcggtatctactttatctgccgaatacagtgctaggggaaaaattataatatttcctctttcgtattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgatagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgatggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttggtaatgaaattattcacaatatcagtatcttctttatctaccagagattttactaacttgataaccttggctgtctcattcaatagggtagtaatatttgtatgtgtgatattgatatcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggttatgttatatgtaacattgagtaaatccttaagttcataatcatcactgtcatcagttatgtacgatccaaacaatgtttctactggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgtaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtataaaacaacgaaattatactagagttgttaaagttaatattttctatgagctgttccaataaattatttgttgtaactgcgttcaagtcataaatcatcttgatactatccagtaaaccgtttttaagttctggaatattattatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagagaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccggatacgtggatatcatatatggtattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctataatcgttaaattttacaaatctataacatgctaaaccttttgacgacaaccattcattaatttctgatatggaatctgtattctcaataccgtatcgttctaaagccagtgctatatctccctgttcgtgagaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatattgtaatattcatcatcgacataacactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctatacgtttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagccgacttgagtttatcaataactacatcagtgtctagatctctagaatatcccaataggtgttccggagaatcagtaaagaacactccacctataggattcttaatatgatacgcagtgctaactggcagacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcattatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccggtgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatcattttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattacatgttttcatattcattaggattattaaatctttaatcttactacgattgtatgcgttgatattgcaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgttttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaaaatacaattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtaataaattttattagaaatgccaaatctataagaaaagtcctcgaattagtttgaagaatatctatatcgccgtaccgtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctcaacacaaactttttcacagagcgatagagtttttgataactcgtttttcttaagaaatataaaactactgtctccagagctcgctctatcttttattttatttaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttggttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtatttcgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatatctacacaggcataaaatgtaggagagttactaggccccactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactaatttattttatcatttttttattcatcatcctctggtggttcgtcgtttctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaatttcataatgagtggaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggaaaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatagtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattacctgcatcttattagaatattaacctaactaaaagacataacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattcccgtatatgaagaaaaagtaaatactgaattcattgctaatggatcgttctctggtagatacgtatcatatcttcgaaagttttctgcccttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacatgatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtaactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagtcagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtaactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaatcttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacagcaatttctttattctctacagatgtaagatacttgaagacattcctatgatgatgcagaattttggataacacggtattgatggtatctgttaccataattcctttgatggctgatagtgtcagagcacaagatttccaatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctacaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattcctttttgcctgtatcatccagttttccatcctttgtaaagaaattattttctactagactattaataagactgataaggattcctccataattgcacaatccaaactttttaacaaaactagactttacaagatctacaggaatgcgtaattcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatattttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcttttatttccacattagatggtaaatccaatagtgaaactatctttttaggaatgtatggactcgcgtttagaggagtgaacgtcttaggcgtcggaaaggatgattcatcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatctggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtttgtgattcgtgttaaaaccatcggagaaggaataaaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggcggtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaagaatttatttctaaatctatgagagatcaacgaaaaggaagagtaggaagagttaatcctgggacatacgtatatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatttttatctagtataaaaaggcgcgccttatgtgtaatgtaatttgactcctttgagcactggctcagagtcgtcttcatcaaatttgcagcaggatccacaagaacaacagcccttgagacaactacagcaactggtcatacagcaaagcataattgtcaccattactatggcaatcaagccagctatgaaacctagccaaatgtaccatggccatttgatatactgctcatactttccaagttcttggagatcgatgagagattcatttaaattcttggcaacctcattgaggcggtcaatttctttctgaatgtttacaactgaagcattaatgccagagatgtcacctaaatcaacatctggtgatgtatgattcttgaaatatttatctaactcctccttgaatgagtctaattcaggttgcaaaggatcataaactgtgttgttgacaattcctattacaacatcacagttaccagacacaaatgtgttgtctgtagtaatgatttgtggttcatagaaattcctttgtgttacaaaccagtgtgtgccatttgaaacaaagacaccttcacgaggaaagtgtgctttaccatcatgacaaatggcaggagcagttgtgaagttcttctcttgtgcagggacataagtcacatgcaagaagactacaccatgaggtgctgactgagggaaggacataagatgatagccctttccacagaaatcaactctcttagattgtccaagtacacactctgacatcttagtagcagcaagattagcagaagctctgatttctgcagctctaattaattgttgagtcacatatgtctgcaaactttgaagtctgcctgtgatcaacctatcaatttgcacttcagcctcaactttgtcaagacgtgaaaggatatcatttaatacacttgaaattgcaccaaagttggagctaagttgtttaacaagcgtgtttaaagcttgtgcattctggttgaccacatcttgaagtttaccaagtgcacttgctgtggaagaaagtgagtcttgaatcttgccaatagcactattaaattggttggcaatcaatttctggttctcatagagaacattctgtgtaactccaataccattaaacctataagccatttgcatagcaaatggtatttgtaatgcagcacctgcaccaaaggtccaaccagaagtgattgtacccgctaacagtgcagaagtgtattgagcaatcatttcatctgtgagcaaaggtggcaatacagtaaggccgttaaacttctgtgcacaaatgaggtctctagcagcaatatcaccaaggcaatcaccatattgtttgatgaagccagcatctgcaagtgtcactttgttgaatagtagatcttcaataaatgacctcttgcttggtttagatggatctggtaatatttgtgagaaattaaatccaccgaaatctttaattggtggtgtcttgtaaatttgtttgacttgtgcaaatacttcttgggtgttcttgtcttgttcaacagctattccagttaaagcacggtttaattgtgtacagaaactgccatattgcaacaatagattgctgcattcagttgaatcaccacaaatgtacattgtacaatctactgatgtcttggtcatagacactggtagaatctctgtggtaacactaatagtaaagtttgtgggtatggcaatagagttattagagtaagcaactgaattctctgcaccaagtgacatagtgtaggcaatgatggattgactagctacactacgtgcccgccgaggagaattagtctgagtctgataactagcgcatatacctgcaccaatgggtatgtcacactcatatgagttgttgacatgttcagctcctattaaacagcctgcacgtgtttgaaatacattagaacctgtagaataaacacgccaagtaggagtaagttgatctgcatgaatagcaacagggacttctgtgcagttaacatcctgataaagaacagcaacctggttagaagtatttgttcctggtgttataacactgacaccaccaaatgaacatggtgtaatgtcaagaatctcaagtgtctgtggatcacggacagcatcagtagtgtcagcaatgtctctgccaaattgttggaaaggcagaaacttcttgttagactcagtaagaacacctgtgcctgttaaaccattgaagttgaaattgacacatttgttcttaaccaaattagtagacttcttaggtccacaaacagttgctggtgcatgtagaagttcaaatgaaagtactactactctgtatggttggtaaccaacaccattagtgggttggaaaccatatgattgtaaaggaaagtaacaattaaatccttcaacaccattacaaggtgtgctaccggcctgatagatttcagttgaaatatctctctcgaaaggtttgagattagacttcctaaacaatctatacaggtaattataattaccaccaaccttagaatcaagattgttagaattccaagctataacgcagcctgtaaagtcatctggtaatttataattataatcagcaatctttccagtttgccctggagcgatttgtctgacttcatcacctctaattacaaatgaatctgcatagacattagtaaagcagagatcatttaatttagtaggagacactccataacacttaaatgtggagaatgatgcggaattatataggacagaataatcagcaacacagttgctgattctcttcctgttccaagcataaacagatgcaaatctggtggcgttaaatacttcaccgaaagggcacaagtttgtaatattaggaaatctaacaatagattctgttggttggactctaaagttagaagtttgatagattcctttctctacagtgaaggatttcaacgtacactttgtttctgagagagggtcaagtgcacagtctacagcatctgtaatggttccattctcattatatttcaataggaaagtcctaggttgaagataacccacataataagctgcagcaccagctgtccaacctgaagaagaatcaccaggagtcaaataacttctatgtaaagcaagtaaagtttgaaacctagtgatgttaatacctattggcaaatctaccaatggttctaaagccgagaaaccctgagggagatcacgcactaaattaataggcgtgtgcttagaatatatcttgaaataaccatcaatattcttaaacacaaattccctaagattcttgaaattaccctgtttaccttcaaggtccataaggaaaggctgagagacatattcgaaagtgcaattattcgcactagaataaactctgaactcactttccatccaactcttgttgttcttgtggtaataaacacccaagaatggatcattacagaattgaaattcacagactttaataacaacattagtagcgttattaacaataagtagggactgggtcttcgaatctaaagtagtaccaaatatccagcctcttattatgttagacttctcagtggaagcgaaataaacaccatcattaaatggtaggacagggttatcaaacctcttagtaccattggtcccagagacatgtatagcatggaaccaagtaacattggagaagaaaggtaagaacaagtcctgagttgaatgtaatactgaggatctgaatactttgtcagggtaataaacaccacgtgtgaaagaattagtgtatgcaggtggtaattgagttctggttgtaagattaacacactgactagagactagtggcaataagacaagaaagacaaacatggtggcggcgtttatcttatttatgattatttctcgctttcaatttaacacaaccctcaagaacctttgtatttattttcaatttttataaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtatctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagagaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgccaattaatgtatgcattagaaccacgcaaggagattgatgtttcagaagttaaaactttatcatcttatatagatttcgaaaatactaaatcagatatcgatgttataaaatctatatcttcgatcttcggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacgtgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgaatgttataaaaatgccggtattgatacatcgtctaaacgaatattaggtaaagatatttttctgagccaaaacttcacagatgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcactgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatgacgtttttagattaatactttcaatgagataaatatgggtggcagagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtaccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatttcacaactttactgtttttaaactgttcaaaatatagcatcgatccatgagaaatacgtttagccgcctttaatagaggaaatcccaccgcctttctggatctcaccaacgacgatagttctgaccagcaacttatttcttcatcatccacctgttttaacatataataggcaggagatagatatccgtcattgcaatattccttttcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgagaatatcacaggggcaatgtttaccacaatgtataatataagaaacaatttgggtctaggagatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcattgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaatcagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctaccgtcctaatataccattaaaaattgttagatttttccgcaataacatggtaactggagtagagatagccgatagatctgttatttcagtcgctgattaatcaattagtagagatgagataagaacattataataatcaataatatattttatatcttatatcttgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattattttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaattatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacacttccagtatcaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgtcaactctcaaaatgctgatttcgacggagatgaagaatggatgatattggagcaaaatcctaaagccgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagtcttaccttactatcttccagactctaaggatccagaaggaagaggttacattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataggtatgtagtagatataatagtcaatagattatacatcaagagagcagaaattaccgaattagtcgtcgaatatatgattgaacgattcatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggcaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttactcttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcattgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcgatttctatttttagatgtgatggaaaaatgactaattttgtagcattagtatcatgaactctaatcgagatcttaatatcttcgtcacacgttagttctttgaagtttttaagagatgcatcagttggttcgaccgatggagtaggtgcaacaattttttgttcgatgtatgtatgtactggagccattgtcttaactataatggtgcttgtatcgaaaaactttaatgcagataatggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatttcatataagaaactataaagtccgcactactgttaagaatgattactaacgcaactatatagtttaaattaagcatcttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtatgatgactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgagataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaaacacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacaatatggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttattacacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcgcctataaaaacctttatgttgcctaaacaagatatagtaggtttggatctggaaaatctatatgccgtaactaagactgacggaattcctataactatcagagttacatcaaaagggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgcggacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagatcaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctgaagatatgcacactgataaatttgtcatttatgatatttatacgtttgattcgttcaagaataaacgattggtatttgtacaggtgcctccatcattaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattctgtcaataagacatcaactacctaaggaatattcaagcgaattactctgtccgaggaaacgaaagactgtagaagctaacatacgagacatgttaatagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagttgtacgaaaaaactttatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtctttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacaaaaaatatcatgttcctattatgaaactatatcctacaccggaagagattccggactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatattaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgaggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagactaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggagccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgttgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggtggatctaatggaatccaattgattaactatcttttgaaaatatacatttttatgatccgatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatacgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcattccaagcgatattatctcaacaaaattcagattctatctttagagtatccactaaactattacggtttatgtactacaatgaactaagagaaatctttagacggttgagaaaaggttctatcaacgatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgtccaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctttaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattaacgataggtgtagccgataaacaaatcatcttatggttttttaatgcgatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccaacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgtgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctaaagacaagttaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattggccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaatacccaacttcaccacccttgaatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaatacagactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcttcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgattatttcctgcacgtttaggtttggtacgttgatttctagcccctgcggatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatattcaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggcgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagccggtgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccatataccaaactttcagaagaaatggtgtacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatacaatatcttcggtatcttgacgcaatctagtatacatagagttaagagaaattagagtttgtacattaagcaacatgtctctaaatgtggctgcaaacttttccttttccacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttctcaacgtcgatttgatgaacacacgatgaaaatgtacttcgatgagattgatcatgtagaaaacaacaagggatacaatatttccacatatcatgaaatatattaagaaatcccaccttattatatttccccaaaggatccatgcatgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcatacgatccaaattccggaatagatgtatcgcacgctctggccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcatcaacgagttaaaaaagaccagttcattcaagataagcaaacgcgataaggatacgctactaaaatattttacttaggactggagttagaatttatagacgactcatttcgtttatcattattagtattcttcttgttatcttgttcagaaatatacagcaatgctatgcctaatactaaatacattatcatgcttgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccattttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatttccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcctgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgccacggttacattcactgcagcattttgaggatcgcgagtatgaagtacgatgttattgtttactggtatatctggaaagaattctaccagtctaggaataagagattgatatcgcatagaaatacaaaagttcataatctcatcatctaagagcattttgttaccattgtaataaatatccactctgtcatatgtataaatgaagtactgttcaaacatgatgagatgtttatatgttggcatagtagtgagatctacgtttggtaatggcaatgtattaagattaactccataatgtctagcagcatctgcgatgttataagcgttgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattctccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgatatcttctatgccaacacaaacaccatccttgggagtagtttatgataaagataaaagaattcagatgttggaggatgaagtggttaatcttagaaatcaacgatctaatacaaaatcatctgataatttagataattttaccagaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaatattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtaggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggatttggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataatttagttcatggaaatatcgctatgattggtatgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatatccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacccgatgaatcggacaatgtactgggccatgtagaataaattatcaacgaattatcgtctacgaacatttatatcatttgttttaattttagtacgcgaataaatagatataaaatagaaaataacagatattacaaccaatgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacggctgcccccatttttaataatcgtcagtatttaaactgttaaatgttggtatatcaacatttaccttatttcccgcagtataaggtttgttgcaggtatactgttcaggaatggttacatttatactttttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtatttgaaacattaacaacgaccgataataaaattactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcagtagatagtttttttgagccatattccacagataatattagacatatgataaaacgattagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattcttctacaaacgattattagattttttcggatcagaggttgtatttataggagacgcccaaaatagacgtactccagatatggtcaaatcaatcaaggaactaaatagatttatattcgtatccaccttattttattccggtactggtttagatattcctagtttggattctttgttcatttgctcggcagtaatcaacaatatgcaaatagagcaattactagggagggtatgtcgagaaacagaactattagataggacggtatatgtatttcctagcacatccatcaaagaaataaagtacatgataggaaatttcgttcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatctttattattattgacctcgtttatcttggaacatggaatgggaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgaaattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgagactatatatggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcacatagctaaagatttgtcacaatatgaatacactacagttcttctagaacgtcagcctagaaggtcgccgtacgtcaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattatggggaaataaagaaaactgtacatggaggcactaatgcaaattacttttccggtaaaaagtctgatgagtatctgagcactacagtcaggtccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaaacactaattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcctggacttaatcatgcattttctagtctattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccgttggaaaactttaataacaaagaaagagataggtctaacgcctattcaaaattagaaagtaatggattagttagactgaatgctttcttggaatccggagacgctatagcacgaaatatctcatcaagaactcttgaagatgattttgctagagataatcagattagctttgatgtttccgaaaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatatcgcggatgaaacggaacttccatacgatgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaaaccgtcttttctggtgtaatattctagtttggtagtagatacatatcaatatcatcaaattcgagatccgaattataaaatgggcgtggattgttaactatagaatcggacgtctgatattcgaaaatctgtggagttttaggttttggtggaggtgtaactgctacttgggatactgaagtctgatattcagaaagctgggggatgttctggttcgacatccaccgatggtgtcacatcactaatcggttcggtaacgtctgtggacgatggaggcaccacttctacaggttctggttctttatcctcagtcatcaacggagctacttcaatgcgaggaaatgtataatttggtaatggtttctcatgtggatctgaagaagaggtaagatatctactagaaagataccgatcacgttctagttctcttttgtagaacttaactttttctttctccgcatctagttgatattccaacctcttcacgttcgcatgggttacctccgcagtttttacgagcgatttcacgttcagccttcatgcgtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgatcattaataagatttttatcattgctcgttatttcagaatcgtatatataaggagtaccatcgtgattcttaccagatattatacaaaatactatatataaaatatattgacccacgttagtaatcatgtaaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagccgttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtagctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggaacaatttacaaattgggatcgtctatcgatagactttctctaaataggactattgttacaaaagttaataattataattatgatacattttttgacgatgatgattgatcgctattgcacaattttgtttttttactttctaatatagcgtttagattctttttcatgtgcgaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctggattataaacgggtgtaaacaagaatacatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacagagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttaaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggtcgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactgtatgtaaacaatctatcactgattaattattcgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgatgatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccgcacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatgcatgcaaagctctaaatccaaattcggatctaattaagatagagactccaaacgagttaagttttttaagaagcattagacgcggatattgggtaggagaatccgaaatattaaaccagacaaccccatataattttatagctaaaaatgccacgaagaatggaactaaaaaacggaaatatatttgtagtacaacgaatactcccaaactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttatattttgtagtaagaatagaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcagcatttcctacatatacccggctatgtaccgcgttatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaatatagtctgtgttccataatagtttactttcatgatttcattatcggtgtattttccaaatacatccactagagcagctgtatgaataatcagatttaccccatctagcgcttctcttaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcgggcacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaatgaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctctaaaggatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaacaagtttatgagcttttataaggataacctagaaaatatagtagatgctatcattactctaaaatatataatgaataatccagattttaaaactacgtatgccgaagtactcggttccagaatagcggatatagatattaaacaagtgatacgtgagaatatactacaattgtctaataatatccgcgaacgatatttgtgaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatatcgcatccgtttgtacatgtaatgatttaaaatgtgtagtcatgcttattgataaagatctaaaaattaaagcgggccctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccaaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaattaaaataacactatttagttggtggtcgccatggatggtgttattgtatactgtctaaacgcgttagtaaaacatggcgaggaaataaatcatataaaaaatgatttcatgattaaaccatgttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcaatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtaaaaaattgaaaataaatacaaaggttcttgagggttgtgttaaattgaaagcgagaaataatcataaataagataaacgccgccaccatgtctgataacggaccacagaatcagcgaaacgcaccacgcattacgtttggtggaccctcagattcaactggcagtaaccagaatggagaacgcagtggagcgcgatctaaacaacgtcggcctcaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaagatgaaagatctcagtccaagatggtatttctactacctaggaactgggccagaagctggacttccctatggtgctaacaaagacggcatcatatgggttgcaactgagggagccttgaatacacctaaagatcacattggcacccgcaatcctgctaacaatgctgcaatcgtgctacaacttcctcaaggaacaacattgcctaaaggcttctacgcagaagggagcagaggcggcagtcaagcctcttctcgttcctcatcacgtagtcgcaacagttcaagaaattcaactccaggcagcagtagaggaacttctcctgctagaatggctggcaatggcggtgatgctgctcttgctttgctgctgcttgacagattgaaccagcttgagagcaagatgtctggtaaaggccaacaacaacaaggccaaactgtcactaagaaatctgctgctgaggcttctaagaagcctcggcagaaacgtactgccactaaagcatacaatgtaacacaagctttcggcagacgtggtccagaacaaacccaaggaaactttggagaccaggaactaatcagacaaggaactgattacaaacattggccgcaaattgcacaatttgctcccagcgcttcagcgttcttcggaatgtcgcgcattggcatggaagtcacaccttcgggaacgtggttgacctacacaggtgccatcaaattggatgacaaagatccaaatttcaaagatcaagtcatattgctgaataagcatattgacgcatacaagacattcccaccaacagagcctaagaaggacaagaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaaggcgcgcctttttatactagtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactttatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagttacagacactgtctcatacactacagtaagtacatcatctggaattgtcactactaaatcaaccaccgatgatgcggatctttatgatacgtacaatgataatgatacagtaccatcaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaacatactgagtttttaggaaatatttacggaacttctaaaactgctgtgaatacagcggctattaataatcgtatttgtgtgatggatctaaacatcgacggtgttagaagttttaaaaatacttacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggttgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcacatatcgccacaaaaactactatgctctaagcggaatcgggtacgagagtctagacttgtgtttggaaggagtagggattcatcatcacgtacttgaaacagaaaacgctgtatatggaaaagttcaacatgattattctactatcaaagagaaggccaaagaaatgaatgcactcagttcaggacctatcatcgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaaccacctctctggaagacagtgtgaatcatgtactcatgaaacgtttggaatctatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatgagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaatctattaatgttaaacatacatctgtttcagctaagcaactaagaacacgtatactctcatcttttgccaacacagagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacacgtgtcgattcatcaaggtatataaacctggggatgaggctacctcgacatacgtgtgcgctatcaaagtggaaagatgctgttgtgctgtgtttgcagattggccagaatcatggtatcaagaagtattctccagatgaataggtgtcacatataaaattttaattaatgtaactatagagaacaaataataggttgtaatatcatatagacaataactaacaattaattagtaactgttatctctttttaactaactaactatacctattaatacatcgtaattatagttcttaacatctattaatcattgattcgcttctttaattttttataaaccaacattgttaattgaaaagggataacatgttacagaatataaattatatatggattttttttaaaaaggaaatacttgactggagtgtatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttatatagatgccgaagacagttacggttgtacattattacatagatgtatatatcactataagaaatcagaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacaatcactacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaagtgcactagtctcgacgtatacggaagtcgtgtacgtaatatcatagcatctattagatatcgtcagagattaattagtctattatccaagaagctggatcctggagataaatggtcgtgttttcctaacgaaataaaatataacgataacgaactgtccacatatctaaaaatcttataaacactattaaaatataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacgtttacatgtgatcagggatatcattcttcggatccaaatgctgtctgcgaaacagataaatggaaatacgaaaatccatgcaaaaaaatgtgcacagtttctgattacatctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtgaatataaatccgttaaaataatgaataattaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggaccaccgactgtaacattaactgaatacgacgaccatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtctccccgctataaaggcattatcaacttctccttattgattgaaaatgaaaatataaatagtttttatgtatagcagtattaccctatagttttattgcttactactaacatggatacagatacagatgttacaaatgtagaagatatcatgaatgaaatagatagagagaaagaagaaatactaaaaaatgtagaaattgaaaataataaaaacattaacaagaatcatcccaatgaatatattagagaagcactcgttattaatacaagtagtaatagtgattccattgataaagaagttatagaatgtatcagtcacgatgtaggaatatagatcatatctactaatttttataatcaatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaatttgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtagactgtttatacaagattgaaatattctttttttatagagtgtggtagtgttacggatatctaatattaatattagactatctctatcgcgctacacgaccaatatcgattactatggatatcttctatgaaaggagagaatgtattcatttctccagcgtcaatctcgtcagtattgacaatactgtattatggagctaatggatccactgctgaacagctatcaaaatatgtagaaaaggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaacaattgtctcctagcaattagtgccgtatactttaaagcaaaatggttgacgccattcgaaaaggaatttaccagtgattatcccttttacgtatcaccaacggaaatggtagacgtaagtatgatgtctatgtacggcgagctatttaatcacgcatctgtaaaagaatcattcggtaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaatttttttcgttggtagatattgctctccgacaactaattgttaaccattttttttaaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtgtagaaatcatccgttgttatataccggatgagcaaaaaaccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctccctttcccagaaacaaactttttttacccactataaaataaaatgagtatactacctgttatatttctttctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcgggcatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagaaggtgttgtaacttcaataggtagtaatttgactattgcgtgtagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttaatatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatatagatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacaatagacacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataatgaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaaaaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagtggaagatacaactgttacgttcattacgacgacgttagaatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctataacgcgactatctaggtatttgtatctcaccgatagagaacatataaatgtagactctattaaacagttgtgtaaaatatcagatcctaatagatgtggatgtacggctttagaaatgagttcattaaaatatgtgatatcaacggaacatatttatataattatactattgctgttagtataattattgattccacggaagaactaccaacagttactccaattacaacaacatataattatactatcgatgatagcactactgaagaactacaagtgactcctcatatggatctccatcgatgatacatgtattaaaatactttccgaataagtcttttaaatattgtattaattatgaaaaactatgctatgcgagtatgatacgatactagattttatctctagcgagagatgtcgttagaatcatttatcaacgaatatcgataacatgtgtcatttatacgttaaagtctgtccgtcttctctattgtttagactgtttgtagaatgctgtgatataaacaaactagtagacacaaatatttaactcatgatgaagttgagaatgatatgctttagctaatataaaaatatattaatccactatatattctagacttgatttaaaaccgataaactactactacgtactgtataagttaggagcagaccctaattatgtagatgatagaggtaatacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtggagatcattaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttcgactgttactctctcgcggagtcgagagactttgtagaaacaacgaaggattaactccgctaggagcatacagtaagcatagatacgtaaaatctcagattgtgcatctactgatatccagctattcgaattcctctaacgaactcaagtcgaatataaatgatttcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctctatccaaggatgtaattaaatgtttgatcgataacaatgtttccatccaatactactggtcttgctcaaccatagatatagagattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtaagtatacctatcattcaatgcatgttggataagacgacggacaacaactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaagatgtatttgatatactaagcaagtacatggatgatatagatatgatcgataactctactatattacgcggtcgatgtcaataatatacaatttgcaaagcggttattggaatatggagcgagtgtcacgctcgataatcaatacggccatccagaaaagcagttaccaaagagaagctagttgatttattactgagttaccatcccactctagagactatgattgacgcatttaatagagatatacgctatctatatcctgaaccattattcgcctgtatcagatacgccttaatcctagatgatgattttccttctaaagtaagtatgatatcgccggtcgtcataaggaactaaagcgctatagagcagacattaatagaatgaagaatgcctacatatcaggcgtctccatgtttgatatattatttaaacgaagcaaacgccacagattgagatacgcaaagaacaatgagaggatcgactccattaaataatttatcatggagtgataatgtcctgtttccatggcatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgcatcgttcgcgacagtatgtggtacatacctaacgtatttatggacgacggtaagaatgaaggtcacgtttctgtcaacaatgtcgacgcgatcgtgtaacacgactcacaatagaatctgtgaatgctctcccgatcatggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacctttaactatatcgatgtggaaattaacctgtatccagttaacgacacatcgtgtactcggacgaccactaccggtctcagcgaatccatctcaacgtcggaactaactattactatgaatcataaagactgcgatcccgtcttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagcgtcgacatctatatactatatagtaataccaatactcaagactacgaaactgatacaatctcttatcatgtgggtaatgtagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtactcaatcaatagcaatcatgaaacaatatatcgtactggcatgcatgtgcctgccagtcttcagcaatcatcctcatcgtgtacggaagaagaaaacaaacatcatatgggaatcgatgttattatcaaagtcacaaagcaagaccaaacaccgaccgatgataagatttgccaatccgtaacggaaattacagagtccgagtcagatccagatcccgaggtggaatcagtcgaggatgtagatcctcctaccacttattactccatcatcggtggaggtctgagaatgaactttggattcaccaaatgtcctcagattaaatccatctcagaatccgctgatggaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaagttacctctcgcgacttcttctttttctgtctcaatagtgtgatacgattatgacactattcctatttcctttcagggtatcacaaaaatattaaacctctttctgatggtctcatacaaaaatatttttattctctttctctctttgatggtctcataaaaaatatttttattctctttctctctttgatggtctcataaaatatttttattctctttctctctttgatggtctcataaaaaatatttttattctctttctctctttgatggtctcataaaatatttttattctctttctctctttgatggtctcataaaaaatatttttattctctttctctctttgatggtctcataaaa

SEQ ID NO: 3 - DNA, 3822 bp, synthetic construct
  source 1..3822: mol_type = other DNA
  misc_feature 1..3822: note = NCBI SARS-CoV-2 reference strain
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 4 - protein, 1273 aa, synthetic construct
  REGION 1..1273: note = NCBI SARS-CoV-2 reference strain
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 5 - DNA, 3822 bp, synthetic construct
  source 1..3822: mol_type = other DNA
  misc_feature 1..3822: note = Wuhan-Hu-1 reference strain
atgtttgtctttcttgtcttattgccactagtctctagtcagtgtgttaatcttacaaccagaactcaattaccacctgcatacactaattctttcacacgtggtgtttattaccctgacaaagtattcagatcctcagtattacattcaactcaggacttgttcttacctttcttctccaatgttacttggttccatgctatacatgtctctgggaccaatggtactaagaggtttgataaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaatgatccattcttgggtgtttattaccacaagaacaacaagagttggatggaaagtgagttcagagtttattctagtgcgaataattgcactttcgaatatgtctctcagcctttccttatggaccttgaaggtaaacagggtaatttcaagaatcttagggaatttgtgtttaagaatattgatggttatttcaagatatattctaagcacacgcctattaatttagtgcgtgatctccctcagggtttctcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttgaaggatttaattgttactttcctttacaatcatatggtttccaacccactaatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgctgacactactgatgctgtccgtgatccacagacacttgagattcttgacattacaccatgttcatttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtatttcaaacacgtgcaggctgtttaataggagctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagagaattcagttgcttactctaataactctattgccatacccacaaactttactattagtgttaccacagaaattctaccagtgtctatgaccaagacatcagtagattgtacaatgtacatttgtggtgattcaactgaatgcagcaatctattgttgcaatatggcagtttctgtacacaattaaaccgtgctttaactggaatagctgttgaacaagacaagaacacccaagaagtatttgcacaagtcaaacaaatttacaagacaccaccaattaaagatttcggtggatttaatttctcacaaatattaccagatccatctaaaccaagcaagaggtcatttattgaagatctactattcaacaaagtgacacttgcagatgctggcttcatcaaacaatatggtgattgccttggtgatattgctgctagagacctcatttgtgcacagaagtttaacggccttactgtattgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccagaaattgattgccaaccaatttaatagtgctattggcaagattcaagactcactttcttccacagcaagtgcacttggtaaacttcaagatgtggtcaaccagaatgcacaagctttaaacacgcttgttaaacaacttagctccaactttggtgcaatttcaagtgtattaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaagatgtcagagtgtgtacttggacaatctaagagagttgatttctgtggaaagggctatcatcttatgtccttccctcagtcagcacctcatggtgtagtcttcttgcatgtgacttatgtccctgcacaagagaagaacttcacaactgctcctgccatttgtcatgatggtaaagcacactttcctcgtgaaggtgtctttgtttcaaatggcacacactggtttgtaacacaaaggaatttctatgaaccacaaatcattactacagacaacacatttgtgtctggtaactgtgatgttgtaataggaattgtcaacaacacagtttatgatcctttgcaacctgaattagactcattcaaggaggagttagataaatatttcaagaatcatacatcaccagatgttgatttaggtgacatctctggcattaatgcttcagttgtaaacattcagaaagaaattgaccgcctcaatgaggttgccaagaatttaaatgaatctctcatcgatctccaagaacttggaaagtatgagcagtatatcaaatggccatggtacatttggctaggtttcatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 6 - protein, 1273 aa, synthetic construct; identical to SEQ ID NO: 4
  REGION 1..1273: note = SARS-CoV-2 S antigen sequence

SEQ ID NO: 7 - DNA, 1260 bp, synthetic construct
  misc_feature 1..1260: note = NCBI SARS-CoV-2 reference strain
  source 1..1260: mol_type = other DNA
atgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaa

SEQ ID NO: 8 - protein, 419 aa, synthetic construct
  REGION 1..419: note = NCBI SARS-CoV-2 reference strain
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 9 - DNA, 1260 bp, synthetic construct
  source 1..1260: mol_type = other DNA
  misc_feature 1..1260: note = Wuhan-Hu-1 reference strain
atgtctgataacggaccacagaatcagcgaaacgcaccacgcattacgtttggtggaccctcagattcaactggcagtaaccagaatggagaacgcagtggagcgcgatctaaacaacgtcggcctcaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaagatgaaagatctcagtccaagatggtatttctactacctaggaactgggccagaagctggacttccctatggtgctaacaaagacggcatcatatgggttgcaactgagggagccttgaatacacctaaagatcacattggcacccgcaatcctgctaacaatgctgcaatcgtgctacaacttcctcaaggaacaacattgcctaaaggcttctacgcagaagggagcagaggcggcagtcaagcctcttctcgttcctcatcacgtagtcgcaacagttcaagaaattcaactccaggcagcagtagaggaacttctcctgctagaatggctggcaatggcggtgatgctgctcttgctttgctgctgcttgacagattgaaccagcttgagagcaagatgtctggtaaaggccaacaacaacaaggccaaactgtcactaagaaatctgctgctgaggcttctaagaagcctcggcagaaacgtactgccactaaagcatacaatgtaacacaagctttcggcagacgtggtccagaacaaacccaaggaaactttggagaccaggaactaatcagacaaggaactgattacaaacattggccgcaaattgcacaatttgctcccagcgcttcagcgttcttcggaatgtcgcgcattggcatggaagtcacaccttcgggaacgtggttgacctacacaggtgccatcaaattggatgacaaagatccaaatttcaaagatcaagtcatattgctgaataagcatattgacgcatacaagacattcccaccaacagagcctaagaaggacaagaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaa

SEQ ID NO: 10 - protein, 419 aa, synthetic construct; identical to SEQ ID NO: 8
  REGION 1..419: note = Wuhan-Hu-1 reference strain

SEQ ID NO: 11 - DNA, 3822 bp, synthetic construct
  source 1..3822: mol_type = other DNA
  misc_feature 986: note = lysine
  misc_feature 987: note = valine
  misc_feature 1..3822: note = Wuhan-Hu-1 reference strain
atgtttgtctttcttgtcttattgccactagtctctagtcagtgtgttaatcttacaaccagaactcaattaccacctgcatacactaattctttcacacgtggtgtttattaccctgacaaagtattcagatcctcagtattacattcaactcaggacttgttcttacctttcttctccaatgttacttggttccatgctatacatgtctctgggaccaatggtactaagaggtttgataaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaatgatccattcttgggtgtttattaccacaagaacaacaagagttggatggaaagtgagttcagagtttattctagtgcgaataattgcactttcgaatatgtctctcagcctttccttatggaccttgaaggtaaacagggtaatttcaagaatcttagggaatttgtgtttaagaatattgatggttatttcaagatatattctaagcacacgcctattaatttagtgcgtgatctccctcagggtttctcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttgaaggatttaattgttactttcctttacaatcatatggtttccaacccactaatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgctgacactactgatgctgtccgtgatccacagacacttgagattcttgacattacaccatgttcatttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtatttcaaacacgtgcaggctgtttaataggagctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagagaattcagttgcttactctaataactctattgccatacccacaaactttactattagtgttaccacagaaattctaccagtgtctatgaccaagacatcagtagattgtacaatgtacatttgtggtgattcaactgaatgcagcaatctattgttgcaatatggcagtttctgtacacaattaaaccgtgctttaactggaatagctgttgaacaagacaagaacacccaagaagtatttgcacaagtcaaacaaatttacaagacaccaccaattaaagatttcggtggatttaatttctcacaaatattaccagatccatctaaaccaagcaagaggtcatttattgaagatctactattcaacaaagtgacacttgcagatgctggcttcatcaaacaatatggtgattgccttggtgatattgctgctagagacctcatttgtgcacagaagtttaacggccttactgtattgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccagaaattgattgccaaccaatttaatagtgctattggcaagattcaagactcactttcttccacagcaagtgcacttggtaaacttcaagatgtggtcaaccagaatgcacaagctttaaacacgcttgttaaacaacttagctccaactttggtgcaatttcaagtgtattaaatgatatcctttcacgtcttgacccacctgaggctgaagtgcaaattgataggttgatcacaggcagacttcaaagtttgcagacatatgtgactcaacaattaattagagctgcagaaatcagagcttctgctaatcttgctgctactaagatgtcagagtgtgtacttggacaatctaagagagttgatttctgtggaaagggctatcatcttatgtccttccctcagtcagcacctcatggtgtagtcttcttgcatgtgacttatgtccctgcacaagagaagaacttcacaactgctcctgccatttgtcatgatggtaaagcacactttcctcgtgaaggtgtctttgtttcaaatggcacacactggtttgtaacacaaaggaatttctatgaaccacaaatcattactacagacaacacatttgtgtctggtaactgtgatgttgtaataggaattgtcaacaacacagtttatgatcctttgcaacctgaattagactcattcaaggaggagttagataaatatttcaagaatcatacatcaccagatgttgatttaggtgacatctctggcattaatgcttcagttgtaaacattcagaaagaaattgaccgcctcaatgaggttgccaagaatttaaatgaatctctcatcgatctccaagaacttggaaagtatgagcagtatatcaaatggccatggtacatttggctaggtttcatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 12 - protein, 1273 aa, synthetic construct
  SITE 986: note = MISC_FEATURE - lysine
  REGION 1..1273: note = Wuhan-Hu-1 reference strain
  SITE 987: note = MISC_FEATURE - valine
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13 - DNA, 3822 bp, synthetic construct
  source 1..3822: mol_type = other DNA
  misc_feature 1..3822: note = Wuhan-Hu-1 reference strain
atgtttgtctttcttgtcttattgccactagtctctagtcagtgtgttaatcttacaaccagaactcaattaccacctgcatacactaattctttcacacgtggtgtttattaccctgacaaagtattcagatcctcagtattacattcaactcaggacttgttcttacctttcttctccaatgttacttggttccatgctatacatgtctctgggaccaatggtactaagaggtttgataaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaatgatccattcttgggtgtttattaccacaagaacaacaagagttggatggaaagtgagttcagagtttattctagtgcgaataattgcactttcgaatatgtctctcagcctttccttatggaccttgaaggtaaacagggtaatttcaagaatcttagggaatttgtgtttaagaatattgatggttatttcaagatatattctaagcacacgcctattaatttagtgcgtgatctccctcagggtttctcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttgaaggatttaattgttactttcctttacaatcatatggtttccaacccactaatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgctgacactactgatgctgtccgtgatccacagacacttgagattcttgacattacaccatgttcatttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtatttcaaacacgtgcaggctgtttaataggagctgaacatgtcaacaactcatatgagtgtgacatacccattggtgcaggtatatgcgctagttatcagactcagactaattctcctggatcagcttcaagtgtagctagtcaatccatcattgcctacactatgtcacttggtgcagagaattcagttgcttactctaataactctattgccatacccacaaactttactattagtgttaccacagaaattctaccagtgtctatgaccaagacatcagtagattgtacaatgtacatttgtggtgattcaactgaatgcagcaatctattgttgcaatatggcagtttctgtacacaattaaaccgtgctttaactggaatagctgttgaacaagacaagaacacccaagaagtatttgcacaagtcaaacaaatttacaagacaccaccaattaaagatttcggtggatttaatttctcacaaatattaccagatccatctaaaccaagcaagaggtcatttattgaagatctactattcaacaaagtgacacttgcagatgctggcttcatcaaacaatatggtgattgccttggtgatattgctgctagagacctcatttgtgcacagaagtttaacggccttactgtattgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccagaaattgattgccaaccaatttaatagtgctattggcaagattcaagactcactttcttccacagcaagtgcacttggtaaacttcaagatgtggtcaaccagaatgcacaagctttaaacacgcttgttaaacaacttagctccaactttggtgcaatttcaagtgtattaaatgatatcctttcacgtcttgacccacctgaggctgaagtgcaaattgataggttgatcacaggcagacttcaaagtttgcagacatatgtgactcaacaattaattagagctgcagaaatcagagcttctgctaatcttgctgctactaagatgtcagagtgtgtacttggacaatctaagagagttgatttctgtggaaagggctatcatcttatgtccttccctcagtcagcacctcatggtgtagtcttcttgcatgtgacttatgtccctgcacaagagaagaacttcacaactgctcctgccatttgtcatgatggtaaagcacactttcctcgtgaaggtgtctttgtttcaaatggcacacactggtttgtaacacaaaggaatttctatgaaccacaaatcattactacagacaacacatttgtgtctggtaactgtgatgttgtaataggaattgtcaacaacacagtttatgatcctttgcaacctgaattagactcattcaaggaggagttagataaatatttcaagaatcatacatcaccagatgttgatttaggtgacatctctggcattaatgcttcagttgtaaacattcagaaagaaattgaccgcctcaatgaggttgccaagaatttaaatgaatctctcatcgatctccaagaacttggaaagtatgagcagtatatcaaatggccatggtacatttggctaggtttcatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 14 - protein, 1273 aa, synthetic construct
  REGION 1..1273: note = Wuhan-Hu-1 reference strain
  SITE 986: note = MISC_FEATURE - lysine
  REGION 682..685: note = MISC_FEATURE - RRAR
  SITE 987: note = MISC_FEATURE - valine
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 15 - DNA, 3765 bp, synthetic construct
  source 1..3765: mol_type = other DNA
  misc_feature 1..3765: note = Wuhan-Hu-1 reference strain
atgtttgtctttcttgtcttattgccactagtctctagtcagtgtgttaatcttacaaccagaactcaattaccacctgcatacactaattctttcacacgtggtgtttattaccctgacaaagtattcagatcctcagtattacattcaactcaggacttgttcttacctttcttctccaatgttacttggttccatgctatacatgtctctgggaccaatggtactaagaggtttgataaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaatgatccattcttgggtgtttattaccacaagaacaacaagagttggatggaaagtgagttcagagtttattctagtgcgaataattgcactttcgaatatgtctctcagcctttccttatggaccttgaaggtaaacagggtaatttcaagaatcttagggaatttgtgtttaagaatattgatggttatttcaagatatattctaagcacacgcctattaatttagtgcgtgatctccctcagggtttctcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttgaaggatttaattgttactttcctttacaatcatatggtttccaacccactaatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgctgacactactgatgctgtccgtgatccacagacacttgagattcttgacattacaccatgttcatttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtatttcaaacacgtgcaggctgtttaataggagctgaacatgtcaacaactcatatgagtgtgacatacccattggtgcaggtatatgcgctagttatcagactcagactaattctcctggatcagcttcaagtgtagctagtcaatccatcattgcctacactatgtcacttggtgcagagaattcagttgcttactctaataactctattgccatacccacaaactttactattagtgttaccacagaaattctaccagtgtctatgaccaagacatcagtagattgtacaatgtacatttgtggtgattcaactgaatgcagcaatctattgttgcaatatggcagtttctgtacacaattaaaccgtgctttaactggaatagctgttgaacaagacaagaacacccaagaagtatttgcacaagtcaaacaaatttacaagacaccaccaattaaagatttcggtggatttaatttctcacaaatattaccagatccatctaaaccaagcaagaggtcatttattgaagatctactattcaacaaagtgacacttgcagatgctggcttcatcaaacaatatggtgattgccttggtgatattgctgctagagacctcatttgtgcacagaagtttaacggccttactgtattgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccagaaattgattgccaaccaatttaatagtgctattggcaagattcaagactcactttcttccacagcaagtgcacttggtaaacttcaagatgtggtcaaccagaatgcacaagctttaaacacgcttgttaaacaacttagctccaactttggtgcaatttcaagtgtattaaatgatatcctttcacgtcttgacccacctgaggctgaagtgcaaattgataggttgatcacaggcagacttcaaagtttgcagacatatgtgactcaacaattaattagagctgcagaaatcagagcttctgctaatcttgctgctactaagatgtcagagtgtgtacttggacaatctaagagagttgatttctgtggaaagggctatcatcttatgtccttccctcagtcagcacctcatggtgtagtcttcttgcatgtgacttatgtccctgcacaagagaagaacttcacaactgctcctgccatttgtcatgatggtaaagcacactttcctcgtgaaggtgtctttgtttcaaatggcacacactggtttgtaacacaaaggaatttctatgaaccacaaatcattactacagacaacacatttgtgtctggtaactgtgatgttgtaataggaattgtcaacaacacagtttatgatcctttgcaacctgaattagactcattcaaggaggagttagataaatatttcaagaatcatacatcaccagatgttgatttaggtgacatctctggcattaatgcttcagttgtaaacattcagaaagaaattgaccgcctcaatgaggttgccaagaatttaaatgaatctctcatcgatctccaagaacttggaaagtatgagcagtatatcaaatggccatggtacatttggctaggtttcatagctggcttgattgccatagtaatggtgacaattatgctttgctgtatgaccagttgctgtagttgtctcaagggctgttgttcttgtggatcctgctgctaa

SEQ ID NO: 16 - protein, 1254 aa, synthetic construct
  REGION 682..684: note = MISC_FEATURE - RRAR
  SITE 987: note = MISC_FEATURE - valine
  REGION 1..1254: note = Wuhan-Hu-1 reference strain
  SITE 986: note = MISC_FEATURE - lysine
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCC

SEQ ID NO: 17 - DNA, 3822 bp, synthetic construct
  source 1..3822: mol_type = other DNA
  misc_feature 1..3822: note = SARS-CoV-2 S antigen
atgttcgtgttcctggtgctgctgccgctggtgagcagccagtgcgtgaacctgacgacccgtacacaactaccacctgcgtacacaaatagcttcaccagaggcgtgtactaccctgataaagtgttcagatcttctgtgctgcacagcacccaggatctgttcctgccgttcttctccaacgtgacctggttccatgccatccacgtgtctggaacaaacggcaccaagaggtttgacaaccctgtgctacccttcaatgacggcgtctactttgctagcaccgagaagagcaatatcatccgcggctggatcttcggcaccaccctggactccaagacccagtccctgctgattgtgaacaacgccaccaacgtggtgatcaaggtctgcgaattccagttctgtaacgacccattcctgggcgtgtattatcataagaacaataagagctggatggaatcagagttccgggtgtactcttctgccaacaactgcaccttcgagtacgtgtctcagcctttcctcatggacctggagggcaagcagggcaacttcaagaacctgagggagtttgtgttcaagaacatcgacgggtacttcaagatctacagcaagcacacacccatcaatctggtgcgagacctgcctcagggcttctcggctctggaacccttggtggatctgcccatcggcatcaacatcaccagattccagacactgctggctcttcacagaagctacctgacgcctggagatagcagcagcggctggaccgccggagccgccgcctattacgtgggctacctgcagcccagaacgttcctgcttaagtacaacgagaacggtacaattaccgatgccgtggactgcgccttagacccgctgagcgagacaaagtgtaccctgaagagctttacagtggagaaaggcatctaccagaccagtaacttcagagtgcagccaaccgaaagcatcgtgcggtttcctaatatcacaaacctgtgtccatttggcgaggtgttcaacgcgaccagattcgcgtctgtctatgcctggaacagaaagcggatcagcaactgcgtggctgactatagcgtgctttacaacagcgcctcctttagcaccttcaagtgctacggcgtcagtcccactaaactgaacgacctctgcttcaccaatgtgtacgcggatagcttcgtgatcagaggagacgaggtgcggcagattgcgcctggacagaccggcaagatcgccgactacaattacaagctgcctgacgacttcacaggctgcgtgatcgcctggaactctaacaatctggacagcaaagtcggtggaaattataactacctgtaccgcctattcagaaagtccaacctgaagccatttgaacgggacatctctaccgaaatctaccaggctggcagcactccttgtaatggcgtagagggcttcaactgttactttccactgcagagctacggcttccagcctaccaatggcgttggataccagccttacagagtggtggtgttgtcgtttgagctgcttcacgcacctgctacagtctgtggccctaagaaatctaccaatctggtaaagaacaagtgcgtgaatttcaactttaacggcctgaccggcacaggagtgctgactgagagcaataagaaattcctgcctttccagcagtttggcagagacatcgccgataccaccgacgccgtacgggatcctcagaccctggaaatcctggacatcacaccgtgtagcttcggcggagtcagcgtgatcacacctggaacaaacacatccaaccaggtggccgtgctgtaccaggacgtaaactgtacagaggtgccagtggccattcacgccgatcagctgacacctacctggcgggtttatagcacgggcagcaacgtcttccagacccgggccggctgcctgatcggcgctgaacacgtgaacaacagctacgagtgcgacatccctatcggagcgggcatctgcgccagctaccagacgcagacaaacagccctggctccgcctcttcggttgccagccagagtatcatcgcctacaccatgagtctgggagccgagaatagcgtggcctacagcaacaacagcatcgctattcccaccaatttcaccatcagcgtgaccaccgaaatcctgcctgtgagcatgaccaagaccagcgtagactgcaccatgtacatctgcggcgactcaaccgaatgtagcaacctgctgctccagtacggcagcttctgcacccagctgaacagagctctgacgggcatcgctgtggaacaagacaagaacacccaggaggtgttcgcccaagtgaaacagatctacaagactcctcctatcaaggacttcggaggcttcaatttctctcagatcttgccagatcctagcaagccaagcaagcggagcttcatcgaagaccttctgtttaacaaggtgacactggccgacgccgggttcatcaagcagtacggcgactgtctcggagacatcgctgccagagacctcatctgcgcccagaaattcaacggcctgactgtgctgcctcctctgctcacagacgagatgatcgcccagtacaccagcgccctcctggccggcaccatcaccagcggctggacgtttggtgctggtgccgccctgcagatccctttcgccatgcagatggcctatcgcttcaacggaatcggcgtgacacagaacgtgctgtacgagaaccagaagctgatcgccaaccagtttaacagcgctatcggcaagatccaagactctctgagttctacagcctctgccctgggcaaactgcaggacgtggtcaaccagaacgcccaggcgctgaataccctggtgaagcagctgagcagcaatttcggtgcgatcagcagcgtgctgaacgacatcctgagcagactggatccgcctgaggccgaagtccagatcgatagactgatcaccggcagactgcaatctctgcagacatacgtgacccagcagctgatccgggctgcggagatccgggccagcgctaacctggccgccaccaagatgagcgagtgcgtgctgggccagtctaagagggttgacttctgcggtaagggctaccacctgatgagcttcccacagtctgcgcctcacggcgttgtgttcctgcacgtgacctacgtgcctgctcaggagaagaacttcaccaccgcgccggccatctgccacgacggcaaggcccacttcccaagagagggtgtatttgtgtctaacggcacccactggttcgtgacacaaaggaacttctacgagcctcagatcataaccaccgacaacaccttcgtgagcggaaactgcgacgtggtgatcggcatcgtgaacaacaccgtgtacgaccctctgcagcctgagctggacagcttcaaagaagaactagacaagtacttcaagaaccacaccagtcccgatgtggacttgggcgatatctctggcattaacgccagcgtcgtgaacatccagaaggagatcgatagactgaacgaggtggccaagaacctgaacgaatcactgatcgacctgcaggagctgggaaagtacgagcagtacatcaagtggccctggtatatctggctgggcttcatcgctggactgatcgccatcgtgatggtgaccatcatgctgtgctgcatgacatcctgctgttcctgcctgaagggctgttgcagctgtggtagctgctgcaagttcgatgaggatgactcagagcctgtgctcaagggagtgaagctgcactacacctga

SEQ ID NO: 18 - DNA, 3822 bp, synthetic construct
  misc_feature 1..3822: note = SARS-CoV-2 S antigen
  source 1..3822: mol_type = other DNA
atgtttgtattcttagtcttgttaccactagtgtcgtctcagtgcgtcaaccttaccacgcgtactcagctaccacctgcctacaccaatagtttcacgcgaggagtttattacccggataaggtcttcagatcgtcggtcctacacagtacgcaagacttgttccttcctttcttcagtaatgtaacatggttccacgctattcacgtttccggtacaaatggaacgaaacgtttcgataacccagtcttaccgttcaatgacggtgtatatttcgcatctacagagaagtcgaatataatccgtggatggatcttcggaaccactttagattccaagactcagtcgttgttgattgtcaacaatgcaacaaatgtcgtgatcaaagtttgtgagtttcaattctgtaatgacccattcttaggtgtgtactaccataagaataacaagtcatggatggaatcagaatttcgtgtctattcttcggcgaacaactgcactttcgagtatgtgagtcaacctttcctaatggacctagagggaaagcagggtaactttaagaatcttcgagaattcgtctttaagaatattgacggttacttcaagatctattccaagcacactcccataaacttggtccgagatctaccacagggtttctccgctctagaacccttagtggatcttcctataggaatcaacatcacgagattccagacattgttagcattgcatcgatcctatcttacgcctggagattcttcatcgggatggactgcaggagccgctgcgtactatgtgggatacttacagcctcgaacattcctacttaagtacaatgagaacggaactatcacagacgcggtggactgtgctttggacccattgtcggagacaaagtgtacccttaagtcattcactgtcgagaagggaatttatcaaacgtccaactttcgtgtgcagccaacagaatccatagtcagatttccaaacattacgaatctttgcccgttcggtgaagtctttaacgccacccgtttcgcatccgtttacgcctggaacagaaagagaatctcgaactgcgtggcggactattctgtactttataactcagcttcattctcaacattcaagtgttatggtgtgtcgccaacaaagctaaatgatctatgcttcaccaacgtatacgcggattcgttcgtaattagaggtgatgaggtgcgacagatcgctcctggacagacaggaaagatagctgattacaattacaagttaccggatgatttcaccggttgcgtgatcgcttggaattctaacaatttggactccaaagttggaggaaactacaactacttatatcgattatttagaaagtccaacttgaaacctttcgagcgtgacataagtacggagatctatcaggccggatcgacaccatgcaatggtgtggagggtttcaattgttactttccacttcaaagttacggattccaaccgacgaacggagtgggttaccagccgtatcgagtcgtagtcctatcatttgagttgctacatgctccagcgaccgtttgcggacctaagaagtccacgaacctagtaaagaacaaatgcgtcaatttcaacttcaacggtttgactggaactggagtgttaactgagtccaacaagaaatttctaccgttccaacaatttggtagagacattgcagacacgacggatgcggtacgtgaccctcaaactttagagatcttagacataacgccttgctccttcggaggagtttccgtgattacgcctggaaccaatacctcaaaccaagtcgctgtgctataccaggatgtgaactgcaccgaggttccagtagctattcacgctgatcagctaacgcctacttggagagtatattcgactggatctaacgtgttccagacacgagctggatgtcttattggtgcagagcatgtcaataactcttatgaatgtgatattccaattggtgcgggaatttgcgcatcataccagacacaaaccaacagtcccggatcagcttcatccgtcgcttcgcaatctatcattgcttacactatgagtctaggagctgagaactcagttgcgtacagtaacaacagtatcgctatacctactaactttacaataagtgtcaccactgaaatcttaccagtatccatgacgaagacctccgttgattgtacaatgtatatatgtggagattcaaccgagtgcagtaacttgttacttcagtatggatccttctgcacacaattgaatcgagcccttaccggtatcgccgtagaacaagataagaacacacaggaggtctttgctcaggtcaagcagatttacaagacaccgccaatcaaggacttcggtggattcaatttctctcagatccttcccgacccgtccaaaccgtctaaacgatcgtttatcgaagatttattgttcaataaggttactttggcggacgctggtttcattaagcagtatggagactgtcttggtgacattgctgcgcgtgaccttatatgcgcccagaagttcaatggacttacagttctaccgccacttctaaccgatgaaatgatcgcgcagtatacatctgcattgttggccggtacgattacatctggatggactttcggtgctggagcagctttgcaaattccgttcgcgatgcaaatggcatacagattcaacggaatcggagtaacgcagaatgtgctatatgagaaccagaaacttatagcaaaccaattcaactcggccatcggtaagattcaggattcgttgtcgagtacagccagtgcgcttggaaagctacaggacgtagttaatcagaatgcgcaagccttgaacacgttagttaagcaactatcttccaactttggtgccatttcttctgtgttgaacgacattctatctcgattagacccacctgaggccgaggttcaaattgatcgattaataaccggaagattgcagtcgctacaaacatatgtaactcagcaattaattagagctgcggaaattcgagcttctgcgaaccttgccgcgacgaagatgtcggaatgcgtgttaggtcagtcaaagcgagtggacttctgtggaaagggataccaccttatgtcctttccgcaatctgcgccacacggtgtggtgtttctacatgtgacctatgtacctgcacaagagaagaactttacgacagcaccagccatctgtcatgatggaaaggcccactttccacgagaaggagtatttgtgtccaatggtacacactggtttgttacccaacgaaatttctatgaaccgcagatcatcacaactgataacacgttcgtctctggaaactgtgacgtagttataggaattgtcaacaatactgtctacgacccattacagccggagcttgattcattcaaagaggagttggataagtacttcaagaaccacaccagtccggatgtggatttaggtgatatctccggtattaacgcttccgtcgttaatatacagaaggaaatcgaccgacttaatgaagtagcaaagaaccttaatgaatccctaatcgatctacaagaacttggtaaatatgagcaatatatcaagtggccttggtacatttggttgggtttcattgcaggattgattgcgattgttatggtcacaataatgctttgttgtatgacgagttgttgttcgtgtttgaagggatgctgctcatgtggttcttgttgtaaattcgatgaagacgattcagaaccggtattgaaaggagttaagttgcactacacgtaa

SEQ ID NO: 19 - DNA, 1260 bp, synthetic construct
  misc_feature 1..1260: note = SARS-CoV-2 N antigen
  source 1..1260: mol_type = other DNA
atgtctgataatggcccgcagaatcagcgcaacgcacctagaatcacatttggcggtcccagcgactctaccggcagcaaccagaacggagaacggagcggagccagaagcaagcaaagacgccctcagggactgcctaacaacaccgccagctggttcactgctctgacccagcacggtaaagaggatctgaagtttcctagaggccaaggagttcctatcaacaccaacagcagcccagacgatcagatcggctactatagaagagccacaagaagaatccgaggcggcgacggcaagatgaaggacctgtcacctagatggtacttctactacctgggcacaggtcccgaagccgggctgccttatggcgcaaataaggacggaatcatctgggtggccacagaaggcgccctgaatacacccaaggaccacatcggcaccagaaacccggccaacaacgccgctatagtgctgcagctgccacagggtaccacgctgccaaagggcttctacgctgagggaagcagaggaggctctcaggcctcttccagaagctcttccagaagcagaaactccagcagaaatagcactcccggcagtagcagaggcacaagccctgctagaatggccggtaatggaggcgacgccgcgctggccctcctgctgctggatcggctgaaccagctggaatctaagatgagcggcaagggccagcaacagcagggccagacagtgaccaagaaatctgccgccgaggctagcaagaaacctcggcagaagaggaccgccaccaaggcctacaacgtgacacaggccttcggtcgtcgcggtcccgagcagacacagggcaacttcggcgaccaggagctgatcagacaaggcacagattacaaacattggcctcagatcgcccagttcgctccaagcgcctctgctttcttcggcatgagcagaatcggcatggaagtgacgccttcaggcacatggctgacctacaccggcgccatcaagctggacgataaggacccgaacttcaaggaccaggtgatcctgctgaacaagcacatcgacgcctacaagaccttccctcctacagagcctaagaaggacaagaagaagaaagccgatgaaacccaggccctgcctcagcggcagaagaagcaacagaccgtgaccctgctgcctgccgccgatctggacgacttcagcaaacaactgcagcaatccatgagctctgccgatagcacccaggcctga

SEQ ID NO: 20 - DNA, 1260 bp, synthetic construct
  source 1..1260: mol_type = other DNA
  misc_feature 1..1260: note = SARS-CoV-2 N antigen
atgtcggataacggtccacagaaccaaagaaatgcacctcgaattacgtttggtggtccttccgactccactggatcgaatcagaatggtgagagaagtggtgcgagatctaaacaacgaagaccgcaaggtttgccgaacaatacagcctcgtggttcaccgcccttacacaacatggtaaagaggacctaaagtttcctcgtggacaaggtgtgcctatcaatacgaattcgagtccggatgatcagattggttattatcgacgagccacgagacgaattcgaggaggtgacggaaagatgaaggacttgtcaccacgttggtatttctactatttgggtacgggacctgaggccggacttccatatggagctaacaaggacggtatcatttgggtggcgaccgaaggagctcttaacacaccaaaggatcatataggtacgcgtaaccctgctaacaacgcagccattgtgttacagttaccacaaggtacgacacttcccaaaggattctatgcggaaggttcccgtggaggatcgcaggcctcgtcacgttcgtcctccagatcgagaaactcttcacgtaactctacgcctggtagttcccgaggaacgagtccggcaagaatggcaggtaatggaggtgatgctgccttagccctattactattagacagacttaatcaattagagagtaagatgtcaggaaagggtcagcaacaacaaggtcagacagtgacaaagaagtctgcggctgaggcatctaagaaaccgagacagaagagaacagctactaaggcgtacaacgtgactcaagcatttggtcgtcgtggaccggaacagactcagggtaactttggtgaccaagagttaatacgtcaaggaactgactacaagcactggcctcagatcgcacaattcgcaccgtcggcctcggctttcttcggaatgtcacgaataggtatggaggtaacaccctcgggaacgtggctaacgtacactggtgcgattaagcttgatgacaaggaccctaacttcaaagaccaagtcatcctacttaacaagcacatagacgcgtataagaccttccctccaactgaacccaagaaagataagaagaagaaagcagatgaaactcaagcattgcctcagcgtcagaagaagcaacagacggttacacttctacctgctgctgatcttgacgatttctcaaagcaattacaacagtcaatgagttcggctgactcaacccaggcttaa

SEQ ID NO: 21 - DNA, 2097 bp, synthetic construct
  misc_feature 1..2097: note = Wuhan reference strain
  source 1..2097: mol_type = other DNA
atgtttgtctttcttgtcttattgccactagtctctagtcagtgtgttaatcttacaaccagaactcaattaccacctgcatacactaattctttcacacgtggtgtttattaccctgacaaagtattcagatcctcagtattacattcaactcaggacttgttcttacctttcttctccaatgttacttggttccatgctatacatgtctctgggaccaatggtactaagaggtttgataaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaatgatccattcttgggtgtttattaccacaagaacaacaagagttggatggaaagtgagttcagagtttattctagtgcgaataattgcactttcgaatatgtctctcagcctttccttatggaccttgaaggtaaacagggtaatttcaagaatcttagggaatttgtgtttaagaatattgatggttatttcaagatatattctaagcacacgcctattaatttagtgcgtgatctccctcagggtttctcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttgaaggatttaattgttactttcctttacaatcatatggtttccaacccactaatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgctgacactactgatgctgtccgtgatccacagacacttgagattcttgacattacaccatgttcatttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtatttcaaacacgtgcaggctgtttaataggagctgaacatgtcaacaactcatatgagtgtgacatacccattggtgcaggtatatgcgctagttatcagactcagactaattctcctcggcgggcacgtagtgtagctagtcaatccatcattgcctacactatgtcataa

SEQ ID NO: 22 - protein, 698 aa, synthetic construct
  REGION 1..698: note = Wuhan reference strain
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMS

SEQ ID NO: 23 - DNA, 2043 bp, synthetic construct
  source 1..2043: mol_type = other DNA
  misc_feature 1..2043: note = Wuhan reference strain
atgtttgtctttcttgtcttattgccactagtctctagtcagtgtgttaatcttacaaccagaactcaattaccacctgcatacactaattctttcacacgtggtgtttattaccctgacaaagtattcagatcctcagtattacattcaactcaggacttgttcttacctttcttctccaatgttacttggttccatgctatacatgtctctgggaccaatggtactaagaggtttgataaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaatgatccattcttgggtgtttattaccacaagaacaacaagagttggatggaaagtgagttcagagtttattctagtgcgaataattgcactttcgaatatgtctctcagcctttccttatggaccttgaaggtaaacagggtaatttcaagaatcttagggaatttgtgtttaagaatattgatggttatttcaagatatattctaagcacacgcctattaatttagtgcgtgatctccctcagggtttctcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttgaaggatttaattgttactttcctttacaatcatatggtttccaacccactaatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgctgacactactgatgctgtccgtgatccacagacacttgagattcttgacattacaccatgttcatttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtatttcaaacacgtgcaggctgtttaataggagctgaacatgtcaacaactcatatgagtgtgacatacccattggtgcaggtatatgcgctagttatcagactcagactaattcttaa

SEQ ID NO: 24 - protein, 680 aa, synthetic construct
  REGION 1..680: note = Wuhan reference strain
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNS

SEQ ID NO: 25 - DNA, 621 bp, synthetic construct
  misc_feature 1..621: note = Wuhan reference strain
  source 1..621: mol_type = other DNA
atgtttgtctttcttgtcttattgccactagtctctagtaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttgaaggatttaattgttactttcctttacaatcatatggtttccaacccactaatggtgttggttaccaaccatacagagtagtagtactttcatttgaacttctacatgcaccagcaactgtt

SEQ ID NO: 26 - protein, 207 aa, synthetic construct
  REGION 1..207: note = Wuhan reference strain
MFVFLVLLPLVSSNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATV

SEQ ID NO: 27 - DNA, 708 bp, synthetic construct
  source 1..708: mol_type = other DNA
  misc_feature 1..708: note = Wuhan reference strain
atgtttgtctttcttgtcttattgccactagtctctagtagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttgaaggatttaattgttactttcctttacaatcatatggtttccaacccactaatggtgttggttaccaaccatacagagtagtagtactttcatttgaacttctacatgcaccagcaactgtttgtggacctaagaagtctactaatttggttaagaacaaatgtgtcaatttc

SEQ ID NO: 28 - protein, 235 aa, synthetic construct
  REGION 1..235: note = Wuhan reference strain
MFVFLVLLPLVSSRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTIYQAGSTPCNGVEGFNCYFPLQSYGFQPTNGVGYQPYRVVVLSFELLHAPATVCGPKKSTNLVKNKCVNF

SEQ ID NO: 29 - DNA, 3813 bp, synthetic construct
  source 1..3813: mol_type = other DNA
  misc_feature 1..3813: note = Wuhan-Hu-1 reference strain
atgtttgtctttcttgtcttattgccactagtctctagtcagtgtgttaactttacaaccagaactcaattaccacctgcatacactaattctttcacacgtggtgtttattaccctgacaaagtattcagatcctcagtattacattcaactcaggacttgttcttacctttcttctccaatgttacttggttccatgctatacatgtctctgggaccaatggtactaagaggtttgctaaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaatgatccattcttgggtgtttattaccacaagaacaacaagagttggatggaaagtgagttcagagtttattctagtgcgaataattgcactttcgaatatgtctctcagcctttccttatggaccttgaaggtaaacagggtaatttcaagaatcttagggaatttgtgtttaagaatattgatggttatttcaagatatattctaagcacacgcctattaatttagtgcgtggtctccctcagggtttctcggctttagaaccattggtagatttgccaataggtattaacatcactaggtttcaaactttacatataagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaatattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttaaaggatttaattgttactttcctttacaatcatatggtttccaacccacttatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgctgacactactgatgctgtccgtgatccacagacacttgagattcttgacattacaccatgttcatttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtatttcaaacacgtgcaggctgtttaataggagctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgtagagaattcagttgcttactctaataactctattgccatacccacaaactttactattagtgttaccacagaaattctaccagtgtctatgaccaagacatcagtagattgtacaatgtacatttgtggtgattcaactgaatgcagcaatctattgttgcaatatggcagtttctgtacacaattaaaccgtgctttaactggaatagctgttgaacaagacaagaacacccaagaagtatttgcacaagtcaaacaaatttacaagacaccaccaattaaagatttcggtggatttaatttctcacaaatattaccagatccatctaaaccaagcaagaggtcatttattgaagatctactattcaacaaagtgacacttgcagatgctggcttcatcaaacaatatggtgattgccttggtgatattgctgctagagacctcatttgtgcacagaagtttaacggccttactgtattgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccagaaattgattgccaaccaatttaatagtgctattggcaagattcaagactcactttcttccacagcaagtgcacttggtaaacttcaagatgtggtcaaccagaatgcacaagctttaaacacgcttgttaaacaacttagctccaactttggtgcaatttcaagtgtattaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaagatgtcagagtgtgtacttggacaatctaagagagttgatttctgtggaaagggctatcatcttatgtccttccctcagtcagcacctcatggtgtagtcttcttgcatgtgacttatgtccctgcacaagagaagaacttcacaactgctcctgccatttgtcatgatggtaaagcacactttcctcgtgaaggtgtctttgtttcaaatggcacacactggtttgtaacacaaaggaatttctatgaaccacaaatcattactacagacaacacatttgtgtctggtaactgtgatgttgtaataggaattgtcaacaacacagtttatgatcctttgcaacctgaattagactcattcaaggaggagttagataaatatttcaagaatcatacatcaccagatgttgatttaggtgacatctctggcattaatgcttcagttgtaaacattcagaaagaaattgaccgcctcaatgaggttgccaagaatttaaatgaatctctcatcgatctccaagaacttggaaagtatgagcagtatatcaaatggccatggtacatttggctaggtttcatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 30 - protein, 1270 aa, synthetic construct
  REGION 1..1270: note = Wuhan-Hu-1 reference strain
MFVFLVLLPLVSSQCVNFTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHISYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 31 - DNA, 3813 bp, synthetic construct
  source 1..3813: mol_type = other DNA
  misc_feature 1..3813: note = Wuhan-Hu-1 reference strain
atgtttgtctttcttgtcttattgccactagtctctagtcagtgtgttaatcttacaaccagaactcaattaccacctgcatacactaattctttcacacgtggtgtttattaccctgacaaagtattcagatcctcagtattacattcaactcaggacttgttcttacctttcttctccaatgttacttggttccatgctatatctgggaccaatggtactaagaggtttgataaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaatgatccattcttgggtgtttaccacaagaacaacaagagttggatggaaagtgagttcagagtttattctagtgcgaataattgcactttcgaatatgtctctcagcctttccttatggaccttgaaggtaaacagggtaatttcaagaatcttagggaatttgtgtttaagaatattgatggttatttcaagatatattctaagcacacgcctattaatttagtgcgtgatctccctcagggtttctcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttgaaggatttaattgttactttcctttacaatcatatggtttccaacccacttatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgatgacactactgatgctgtccgtgatccacagacacttgagattcttgacattacaccatgttcatttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtatttcaaacacgtgcaggctgtttaataggagctgaacatgtcaacaactcatatgagtgtgacatacccattggtgcaggtatatgcgctagttatcagactcagactaattctcatcggcgggcacgtagtgtagctagtcaatccatcattgcctacactatgtcacttggtgcagagaattcagttgcttactctaataactctattgccatacccataaactttactattagtgttaccacagaaattctaccagtgtctatgaccaagacatcagtagattgtacaatgtacatttgtggtgattcaactgaatgcagcaatctattgttgcaatatggcagtttctgtacacaattaaaccgtgctttaactggaatagctgttgaacaagacaagaacacccaagaagtatttgcacaagtcaaacaaatttacaagacaccaccaattaaagatttcggtggatttaatttctcacaaatattaccagatccatctaaaccaagcaagaggtcatttattgaagatctactattcaacaaagtgacacttgcagatgctggcttcatcaaacaatatggtgattgccttggtgatattgctgctagagacctcatttgtgcacagaagtttaacggccttactgtattgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccagaaattgattgccaaccaatttaatagtgctattggcaagattcaagactcactttcttccacagcaagtgcacttggtaaacttcaagatgtggtcaaccagaatgcacaagctttaaacacgcttgttaaacaacttagctccaactttggtgcaatttcaagtgtattaaatgatatccttgcacgtcttgacaaagttgaggctgaagtgcaaattgataggttgatcacaggcagacttcaaagtttgcagacatatgtgactcaacaattaattagagctgcagaaatcagagcttctgctaatcttgctgctactaagatgtcagagtgtgtacttggacaatctaagagagttgatttctgtggaaagggctatcatcttatgtccttccctcagtcagcacctcatggtgtagtcttcttgcatgtgacttatgtccctgcacaagagaagaacttcacaactgctcctgccatttgtcatgatggtaaagcacactttcctcgtgaaggtgtctttgtttcaaatggcacacactggtttgtaacacaaaggaatttctatgaaccacaaatcattactacacacaacacatttgtgtctggtaactgtgatgttgtaataggaattgtcaacaacacagtttatgatcctttgcaacctgaattagactcattcaaggaggagttagataaatatttcaagaatcatacatcaccagatgttgatttaggtgacatctctggcattaatgcttcagttgtaaacattcagaaagaaattgaccgcctcaatgaggttgccaagaatttaaatgaatctctcatcgatctccaagaacttggaaagtatgagcagtatatcaaatggccatggtacatttggctaggtttcatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 32 - protein, 1270 aa, synthetic construct
  REGION 1..1270: note = Wuhan-Hu-1 reference strain
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIDDTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILARLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 33 - DNA, 3822 bp, synthetic construct
  misc_feature 1..3822: note = Wuhan-Hu-1 reference strain
  source 1..3822: mol_type = other DNA
atgtttgtctttcttgtcttattgccactagtctctattcagtgtgttaatcttacaaccagaactcaattaccacctgcatacactaattctttcacacgtggtgtttattaccctgacaaagtattcagatcctcagtattacattcaactcaggacttgttcttacctttcttctccaatgttacttggttccatgctatacatgtctctgggaccaatggtactaagaggtttgataaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaatgatccattcttgggtgtttattaccacaagaacaacaagagttgcatggaaagtgagttcagagtttattctagtgcgaataattgcactttcgaatatgtctctcagcctttccttatggaccttgaaggtaaacagggtaatttcaagaatcttagggaatttgtgtttaagaatattgatggttatttcaagatatattctaagcacacgcctattaatttagtgcgtgatctccctcagggtttctcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattaccggtatagattgtttaggaagtctaatctcaaacctttcgagagagatatttcaactgaaatctatcaggccggtagcacaccttgtaatggtgttgaaggatttaattgttactttcctttacaatcatatggtttccaacccactaatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgctgacactactgatgctgtccgtgatccacagacacttgagattcttgacattacaccatgttcatttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtatttcaaacacgtgcaggctgtttaataggagctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagagaattcagttgcttactctaataactctattgccatacccacaaactttactattagtgttaccacagaaattctaccagtgtctatgaccaagacatcagtagattgtacaatgtacatttgtggtgattcaactgaatgcagcaatctattgttgcaatatggcagtttctgtacacaattaaaccgtgctttaactggaatagctgttgaacaagacaagaacacccaagaagtatttgcacaagtcaaacaaatttacaagacaccaccaattaaagatttcggtggatttaatttctcacaaatattaccagatccatctaaaccaagcaagaggtcatttattgaagatctactattcaacaaagtgacacttgcagatgctggcttcatcaaacaatatggtgattgccttggtgatattgctgctagagacctcatttgtgcacagaagtttaacggccttactgtattgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccagaaattgattgccaaccaatttaatagtgctattggcaagattcaagactcactttcttccacagcaagtgcacttggtaaacttcaagatgtggtcaaccagaatgcacaagctttaaacacgcttgttaaacaacttagctccaactttggtgcaatttcaagtgtattaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaagatgtcagagtgtgtacttggacaatctaagagagttgatttctgtggaaagggctatcatcttatgtccttccctcagtcagcacctcatggtgtagtcttcttgcatgtgacttatgtccctgcacaagagaagaacttcacaactgctcctgccatttgtcatgatggtaaagcacactttcctcgtgaaggtgtctttgtttcaaatggcacacactggtttgtaacacaaaggaatttctatgaaccacaaatcattactacagacaacacatttgtgtctggtaactgtgatgttgtaataggaattgtcaacaacacagtttatgatcctttgcaacctgaattagactcattcaaggaggagttagataaatatttcaagaatcatacatcaccagatgttgatttaggtgacatctctggcattaatgcttcagttgtaaacattcagaaagaaattgaccgcctcaatgaggttgccaagaatttaaatgaatctctcatcgatctccaagaacttggaaagtatgagcagtatatcaaatggccatggtacatttggctaggtttcatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 34 - protein, 1273 aa, synthetic construct
  REGION 1..1273: note = Wuhan-Hu-1 reference strain
MFVFLVLLPLVSIQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSCMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 35 - DNA, 3822 bp, synthetic construct
  misc_feature 1..3822: note = Wuhan-Hu-1 reference strain
  source 1..3822: mol_type = other DNA
atgtttgtctttcttgtcttattgccactagtctctagtcagtgtgttaactttacaaacagaactcaattaccatctgcatacactaattctttcacacgtggtgtttattaccctgacaaagtattcagatcctcagtattacattcaactcaggacttgttcttacctttcttctccaatgttacttggttccatgctatacatgtctctgggaccaatggtactaagaggtttgataaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaattatccattcttgggtgtttattaccacaagaacaacaagagttggatggaaagtgagttcagagtttattctagtgcgaataattgcactttcgaatatgtctctcagcctttccttatggaccttgaaggtaaacagggtaatttcaagaatcttagcgaatttgtgtttaagaatattgatggttatttcaagatatattctaagcacacgcctattaatttagtgcgtgatctccctcagggtttctcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaacgattgctgattataattataaattaccagatgactttacaggctgcgttatagcttggaattctaacaatcttgattctaaggttggtggtaattataattacctgtatagattgtttaggaagtctaatctcaaacctttcgagagagatatttcaactgaaatctatcaggccggtagcacaccttgtaatggtgttaaaggatttaattgttactttcctttacaatcatatggtttccaacccacttatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgctgacactactgatgctgtccgtgatccacagacacttgagattcttgacattacaccatgttcatttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtatttcaaacacgtgcaggctgtttaataggagctgaatatgtcaacaactcatatgagtgtgacatacccattggtgcaggtatatgcgctagttatcagactcagactaattctcctcggcgggcacgtagtgtagctagtcaatccatcattgcctacactatgtcacttggtgcagagaattcagttgcttactctaataactctattgccatacccacaaactttactattagtgttaccacagaaattctaccagtgtctatgaccaagacatcagtagattgtacaatgtacatttgtggtgattcaactgaatgcagcaatctattgttgcaatatggcagtttctgtacacaattaaaccgtgctttaactggaatagctgttgaacaagacaagaacacccaagaagtatttgcacaagtcaaacaaatttacaagacaccaccaattaaagatttcggtggatttaatttctcacaaatattaccagatccatctaaaccaagcaagaggtcatttattgaagatctactattcaacaaagtgacacttgcagatgctggcttcatcaaacaatatggtgattgccttggtgatattgctgctagagacctcatttgtgcacagaagtttaacggccttactgtattgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccagaaattgattgccaaccaatttaatagtgctattggcaagattcaagactcactttcttccacagcaagtgcacttggtaaacttcaagatgtggtcaaccagaatgcacaagctttaaacacgcttgttaaacaacttagctccaactttggtgcaatttcaagtgtattaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctattaagatgtcagagtgtgtacttggacaatctaagagagttgatttctgtggaaagggctatcatcttatgtccttccctcagtcagcacctcatggtgtagtcttcttgcatgtgacttatgtccctgcacaagagaagaacttcacaactgctcctgccatttgtcatgatggtaaagcacactttcctcgtgaaggtgtctttgtttcaaatggcacacactggtttgtaacacaaaggaatttctatgaaccacaaatcattactacagacaacacatttgtgtctggtaactgtgatgttgtaataggaattgtcaacaacacagtttatgatcctttgcaacctgaattagactcattcaaggaggagttagataaatatttcaagaatcatacatcaccagatgttgatttaggtgacatctctggcattaatgcttcatttgtaaacattcagaaagaaattgaccgcctcaatgaggttgccaagaatttaaatgaatctctcatcgatctccaagaacttggaaagtatgagcagtatatcaaatggccatggtacatttggctaggtttcatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 36 - protein, 1273 aa, synthetic construct
  REGION 1..1273: note = Wuhan-Hu-1 reference strain
MFVFLVLLPLVSSQCVNFTNRTQLPSAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNYPFLGVYYHKNNKSWMESEFRVYSSANNCTFEYVSQPFLMDLEGKQGNFKNLSEFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAAIKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASFVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 37 - DNA, 3822 bp, synthetic construct
  source 1..3822: mol_type = other DNA
  misc_feature 1..3822: note = Wuhan-Hu-1 reference strain
atgtttgtcttcttggtccttctgccgcttgtttcttcacaatgtgtgaatttgaccacccgcacccagctgcctcctgcatatacgaattcattcactcgcggcgtgtactatccagataaagtctttcgatccagtgtactgcattcaacgcaagatctctttcttccattcttcagcaatgtgacctggttccacgcgatacacgtaagcggaaccaacggaacaaagagatttgacaatccagtactcccgtttaatgacggtgtctactttgcctctaccgagaagtctaatatcataagagggtggatcttcggtacgacgctcgattctaagacgcaaagcctgcttattgttaataatgccaccaatgtcgtgattaaggtatgcgaatttcaattctgtaacgatccattccttggagtttactatcataagaacaacaaatcctggatggaatcagagtttcgggtctacagctccgcaaataactgtacgtttgagtacgtgtcccagccctttcttatggatctcgaaggtaaacaaggcaatttcaagaatcttagagaattcgtcttcaagaacatcgatggatactttaagatatactcaaagcatacgccgataaacctcgtgcgcgacctgccacagggattcagtgcgcttgagccattggtagatcttcctataggaatcaacataactagatttcagacactgctggcgcttcatagatcctatctgactccaggtgactcctccagtggatggactgccggcgccgcggcttactacgtgggttatcttcagcctcgaacgtttcttctgaagtataacgagaacgggacgataaccgatgcggtggattgcgcactggaccctcttagcgaaactaaatgtacccttaagagctttacggttgagaagggtatttatcagactagtaactttcgcgtgcagcccacggaatcaattgtgcggtttcccaatattacaaacttgtgccctttcggcgaggtcttcaatgcaacgcgctttgcgtcagtttacgcctggaataggaagaggatatcaaactgcgtggctgactattctgtgctttacaactctgctagtttcagtacctttaagtgttacggtgtgagtccgacgaagctcaatgatctttgtttcactaatgtatacgcggacagtttcgttatacgaggagacgaggtccggcaaatcgcacccggccaaacgggaaagattgctgactacaactacaaattgcccgatgactttacgggatgcgtcattgcatggaattctaataatctggatagcaaagtaggtggaaactataattatctctaccggctcttccgaaagagtaatctcaaaccgtttgaaagagatattagcacggaaatatatcaagccggctccacaccatgtaatggagttgaaggctttaattgttatttcccgttgcaaagttacggatttcagcccacgaacggtgtgggttatcaaccgtatcgggtcgtagttctcagcttcgagctgcttcatgcgcccgcgactgtttgcggtcctaagaagtcaaccaatctcgtaaagaacaagtgtgtgaacttcaacttcaatggactcacagggacgggcgtgcttacggagtcaaacaagaagtttcttcctttccagcaattcggcagggacattgccgatacaacggacgcagttagggaccctcaaactcttgaaatcttggacataactccttgcagctttggcggcgtgagtgtgataacacctggtaccaatacgtccaatcaggtagcagtactgtatcaggatgtcaattgcaccgaagtccctgtcgccattcatgccgaccaactgacgccaacatggcgagtatacagtaccgggtcaaacgtgttccagaccagggcaggctgtctcattggtgcggaacacgttaacaacagttacgaatgcgatatacctattggtgctggcatctgtgcctcttaccagacccaaactaactcaccacgaagggcaagatcagttgccagtcagtctattatcgcttacacgatgtcactgggagctgagaactctgttgcttactcaaataattcaattgccatcccaacgaatttcactattagtgtaacaacggaaattctgcccgtgtccatgaccaagacgtccgtcgattgtaccatgtacatatgcggtgacagcaccgaatgtagcaacctcctgctccaatatggtagcttctgcacacagctcaacagagcacttacaggtatcgccgtagagcaagacaagaacacacaagaagtgttcgctcaggtgaagcagatctacaagactccaccgataaaggacttcggtggctttaactttagccaaatcctgcccgacccttctaagccttctaagagatcctttattgaggatctcttgttcaacaaagtcaccctcgctgacgcagggtttataaagcagtatggtgactgtctcggcgatatagcagccagagacttgatctgcgcccagaagttcaacgggcttacggttcttccgccgctgcttactgatgaaatgatagctcaatacacatctgctcttctcgctgggacaataacttccgggtggacgttcggagcgggtgccgccttgcaaattccctttgcgatgcagatggcttatcgcttcaatggcataggcgttacccagaacgtgctgtacgagaatcagaaattgatcgccaaccagtttaattctgccatcggaaagatccaagattccctgtctagcactgcgtcagccctcggtaaactgcaggatgtggttaatcagaatgctcaggctctcaacactctggttaaacagctgtctagcaacttcggtgccatctcttcagttcttaacgatatattgagtaggcttgataaagtcgaggcagaggttcaaattgaccggttgatcacgggcaggcttcaatcactgcaaacctacgtcactcaacaactgattcgcgcagcggaaatacgagcttcagctaatctcgcagcgactaagatgtccgagtgtgtgctcggtcagagcaagagagttgacttctgtgggaaagggtaccatctcatgtcatttcctcaatctgcaccgcacggagtagtattcctccacgttacttatgtgccggcacaagagaagaacttcactactgcgccagccatttgtcacgacgggaaagcgcactttcccagggaaggagtcttcgtatcaaacggtacgcattggttcgtaacgcaaagaaacttctatgaaccacaaattatcacgacggataatacgtttgtctccgggaactgtgacgtggtaattggtattgtaaataacacagtttatgacccattgcaacctgaactggacagcttcaaggaggaattggacaagtatttcaagaaccataccagtccggacgtagacctcggcgatatctcaggaattaacgctagcgtggtgaatattcagaaagaaatagatcgcctgaacgaagtagcgaagaaccttaacgaaagtttgattgatcttcaggagctgggtaaatacgagcaatacataaagtggccgtggtacatctggctcggctttatagctggcctgatcgccattgtgatggtgactattatgttgtgttgcatgactagctgctgttcatgtcttaagggatgctgcagctgcggtagctgctgtaaatttgacgaagacgatagcgagccggtactgaaaggtgtgaaacttcattacacataa

SEQ ID NO: 38 - DNA, 3813 bp, synthetic construct
  source 1..3813: mol_type = other DNA
  misc_feature 1..3813: note = B.1.351 variant
atgttcgtgtttcttgtgttgttgccactggtttcatcccaatgtgtgaactttaccaccaggacgcagttgccaccagcttatactaattccttcactagaggagtgtactacccggacaaggtattccggtctagtgtccttcactccacgcaagacctgttccttccgttcttctccaatgtaacctggtttcacgccattcatgtttcaggcacgaatggcactaagcgcttcgccaacccagtactgccgtttaatgatggagtctacttcgcttcaacagagaagagcaatatcatacgaggctggatctttggtactaccttggattccaagacgcaatcccttcttattgtcaataatgcgaccaacgttgtaatcaaagtatgcgagtttcaattctgcaacgacccattcttgggcgtctattatcataagaataataagtcttggatggagtctgagttcagagtgtattcatcagcgaacaattgcacattcgaatatgtatctcagccctttctcatggatctcgaagggaagcaagggaacttcaagaatctccgcgagttcgtctttaagaacattgacggctatttcaagatatacagcaaacatactccaatcaacctggttcgaggactccctcagggcttctccgcgctggaacccttggtggacctcccaataggcataaatatcacgaggttccaaacattgcacataagctatctgactccgggagacagttccagcggttggactgcaggcgcggctgcgtactacgtgggctacttgcaacctaggacgtttctcttgaaatacaatgagaacggcaccatcacggatgcagttgactgtgctctcgacccactctccgaaaccaagtgtacgctcaagtcatttaccgtcgagaaaggaatctaccaaactagtaatttccgcgttcagcctacagagtcaattgtgcgatttcctaacatcactaacctgtgcccgtttggagaagtatttaatgcgactcgcttcgctagtgtctatgcgtggaatcgaaagcggatctcaaactgtgtggcagattattccgtcctgtataatagtgccagcttctcaacgtttaaatgctacggagttagcccaacgaagctgaacgacttgtgctttacgaacgtgtatgccgattccttcgtcatccgcggagacgaagttcgccaaatcgcaccaggtcaaacgggtaatatagcggactacaactacaagctgcccgacgatttcactgggtgcgtgatcgcgtggaatagtaacaacttggactccaaagtgggtggcaactacaactatctgtataggctgtttcgaaagtccaacttgaaaccgtttgaaagggatattagtacagagatctatcaagctggtagcacaccctgcaacggtgttaaaggctttaactgctactttcctttgcagagctatggatttcagcctacttatggagtcggttaccaaccttatcgcgtcgtagtactgagtttcgaactccttcatgcacccgcaactgtgtgcgggccaaagaagtctaccaatttggtcaagaataagtgtgtaaacttcaacttcaacggtctcacagggaccggtgtattgacagagtcaaacaagaagttcttgccctttcaacagttcggcagggatattgctgacactaccgatgcggttagggaccctcaaaccctggagattcttgacattacaccgtgcagcttcggtggagtcagcgttatcacaccaggcactaatacgtccaatcaagttgctgtactgtaccaaggagtcaattgtaccgaggtaccagtagcgattcacgccgaccaactcacgcccacatggcgcgtctatagcacaggcagcaatgtatttcaaacgcgcgcaggatgtctcattggagcggagcatgtcaataactcatacgaatgtgacattccaataggagcgggtatttgtgccagctaccagacgcaaacgaattctccacgccgagccagatcagtcgcgagtcagagtataatagcgtacacgatgtctctgggcgtcgagaattccgtcgcatactcaaacaattccattgcgatcccaacgaacttcacaatatccgtcaccactgaaatcctccctgttagcatgactaagacaagcgtggactgcactatgtatatttgtggtgattccacggaatgctctaatctgcttctccaatatggaagtttctgcacccaactgaacagggcgcttacaggcatagcagttgaacaagacaagaatacccaagaggtctttgcccaggtgaaacaaatttataagactcctccgatcaaggactttggagggttcaacttctcccagatacttcccgacccgagcaagccctccaagagatcgtttatagaagatctcctctttaacaaggtcacgttggctgatgccggctttattaaacaatacggtgactgtctcggagatatcgcggctagagacctgatatgtgcacagaaatttaacgggctcaccgtattgccaccgctgctgacggatgaaatgatcgcccaatacacctccgcgttgttggccgggaccattacttctggttggacatttggtgcaggagccgcacttcagataccatttgctatgcaaatggcgtatcgattcaacgggattggtgttacgcagaatgtcctctatgagaaccagaaactgatagcgaatcagttcaacagcgctattggcaagatccaagattctttgtcatcaaccgcgagtgccctgggtaaactgcaagatgtagtcaaccagaacgcacaagcccttaatacccttgtcaagcagctctcatccaactttggtgctatttcttctgttctgaatgatattctcagtcgactggacaaggtagaagcagaggttcagatagatcgcctcattactgggcgccttcagtcacttcagacttatgttacccaacaactcattagggcagccgaaatccgagcttcagcgaatctcgccgctactaagatgagcgagtgcgtacttggtcaatccaagagagtagatttctgtgggaagggatatcacctgatgtctttcccacagagcgcgccacacggtgtagtattcttgcatgttacatacgttccagcacaagagaagaactttactacagcaccggcaatctgccatgatgggaaggcacactttccgagggagggagtctttgtatccaatggcacccactggtttgttactcaaagaaatttctatgagccacagatcattactacggacaacacctttgtaagcgggaactgtgacgtagtcataggcatagtaaataataccgtttacgatccactgcagccggagctcgattcattcaaagaggaactggacaaatacttcaagaaccacacgtcacctgacgttgaccttggtgatatttctggcataaacgcctctgttgtgaatatccagaaggagatagacagactgaacgaggtggcaaagaatctgaacgaatcattgatcgatttgcaagagttgggaaagtacgaacagtatataaagtggccgtggtatatatggctagggttcattgctggacttatagcaattgtgatggtaacgatcatgttgtgttgcatgacttcctgctgcagttgcctcaaaggatgttgttcctgtggatcatgctgtaagtttgatgaagatgactccgaacccgtgcttaaaggagtgaagttgcactatacttaa

SEQ ID NO: 39 - DNA, 3813 bp, synthetic construct
  misc_feature 1..3813: note = B.1.1.7 variant
  source 1..3813: mol_type = other DNA
atgtttgtctttctcgtacttctgcctctggtcagcagccaatgtgtgaacctcacaaccaggactcaattgccgccagcgtatacgaacagcttcacgcgcggcgtttattatccggataaggtattccgcagcagtgtgcttcatagtacacaggacctattcttgccgttcttctcaaacgtgacatggttccatgccattagtggcacaaacgggacaaagcggttcgacaacccggttcttccctttaatgacggagtatactttgcaagcacggagaagagcaacatcattagagggtggatctttgggaccacattggattccaagacgcagtccctgctgatagtcaacaacgctaccaacgtcgtcatcaaggtttgtgaattccaattctgcaacgatccgtttctgggagtttatcacaagaacaataaatcttggatggagagtgaatttcgcgtttactcatccgcaaataattgtaccttcgagtacgtgtcccagcctttcctcatggacttggagggtaagcagggaaactttaagaatctgagagaatttgtctttaagaacattgacgggtacttcaagatatactcaaagcatacacccattaacctggtgagggatttgccgcagggattctcagcactggagccactcgttgatctgccgatagggataaatatcacgcggttccaaactcttcttgctttgcaccgctcttaccttactccaggagactcttcctctgggtggacggctggagcggctgcttattacgtcgggtacttgcagccgcggaccttccttctgaaatacaatgagaacggtacaattactgacgctgtggattgcgccctggatccgctgtctgagacgaaatgcacgcttaagtcatttacggtcgagaagggaatctatcagacatccaactttcgagtgcagcccacagaatccatagttcgattccctaacatcactaatttgtgtccatttggtgaagtgtttaacgcgaccaggttcgccagcgtttatgcatggaatagaaagcggatcagtaattgcgtggccgattattctgtcctgtataattcagcatccttctctactttcaagtgttatggtgtttcaccaaccaaattgaacgatctctgcttcactaatgtttatgcagacagctttgtgatacgaggagatgaggtcagacagattgctcccgggcaaacgggaaagattgctgattataactacaagctgcctgacgactttacgggctgtgtcatagcgtggaacagcaataacctcgatagtaaggtaggcggtaattacaactacctgtatagactgtttcggaagtccaatctgaagcctttcgaacgcgatattagtaccgagatctatcaggcaggttccacaccttgcaatggagtggagggctttaattgctatttccctctgcaatcctacggattccaaccaacctatggcgttggctaccagccttatcgggtggtcgtgctttcctttgaacttcttcacgcacccgctactgtatgtggccctaagaagagcactaaccttgtgaagaacaaatgcgtcaatttcaactttaatgggctgaccggaaccggagtcctcacagagagcaacaagaaattccttccgtttcagcagttcggtagggatatagatgacacgactgatgcggtccgggatcctcaaacgcttgagattcttgacatcacgccgtgcagctttggtggagttagtgtaattactccgggtaccaatactagcaaccaagttgccgtactttatcaaggtgtaaactgcactgaagtaccggtcgccattcatgcagaccagctcacaccaacgtggagggtttattccactggatccaatgtctttcaaacaagagcgggctgtttgattggagcggaacatgttaacaacagttacgagtgtgacatacctataggagctggcatctgtgcgagctaccagacacaaaccaactctcatagacgggcacgctccgtggcatctcagtctatcatagcgtatacgatgagtttgggagcagagaattctgttgcatactctaacaatagtatcgccattccgattaactttaccatctcagtaacgaccgaaatacttcccgtctctatgactaagacaagtgtggactgcaccatgtacatttgcggtgactctaccgagtgctctaatttgctattgcaatatgggtcattctgtactcagctgaatagggccttgactgggatagccgtcgaacaagacaagaatacgcaggaggtattcgcccaagtaaagcaaatatataagacacctcccatcaaagactttggagggttcaatttcagtcagatcctacccgatccaagtaagccatcaaagaggagcttcatcgaggatctgctattcaataaggttaccctcgctgacgctggcttcatcaagcagtatggagattgcctcggcgacatagcagcacgagatcttatttgtgcacagaaatttaatggactcaccgttctcccacctctcctcacagacgaaatgatcgcacagtacacttctgccctcctcgccgggacgattactagcggctggacatttggcgctggtgctgctctgcagattccatttgctatgcagatggcttatcgctttaacgggatcggagtcacgcagaatgttctttacgagaaccagaaacttattgcgaaccagttcaactctgcgattgggaagatacaggatagcctttcctctactgcctctgcacttggtaagttgcaagacgttgtgaaccagaatgctcaagcattgaacacactggtgaagcagcttagttctaacttcggtgctatcagtagtgttctcaatgatatcctggctcggctcgacaaggtggaggccgaagtacaaatcgatagactcataaccggaagactgcaatccttgcagacatacgttacccagcaacttatacgggccgccgaaatacgagcgtcagcaaacttggccgccaccaagatgtctgaatgcgtcttgggccaaagcaagcgagtggacttctgcggtaaaggttatcatttgatgtcattccctcaatccgctcctcatggagtggtgtttcttcatgttacttacgtgcctgcacaagagaagaatttcaccactgctccagccatttgtcatgatgggaaagcccatttcccaagggaaggagtattcgtctcaaatggaacacattggttcgtaacacagagaaacttctacgaaccacaaatcataacaacccacaatacgttcgtttcagggaactgcgatgtcgtaatcggaatagtaaacaatacggtctatgacccattgcaaccagagcttgactctttcaaagaagagttggataagtactttaagaatcatacgtctccggacgtagatcttggcgatataagtggcattaatgcttctgttgtgaatatacagaaagaaatcgacagacttaacgaggtcgcgaagaatctgaacgagtcattgatagaccttcaggaattgggcaagtatgaacagtacattaaatggccgtggtacatatggctagggtttatagcaggccttatagcaatcgtcatggttaccatcatgctttgctgtatgaccagttgctgctcatgcctgaagggttgttgttcctgcggatcttgctgtaagttcgatgaagacgattctgagcctgtcctcaaaggagtaaagctccattacacctaa

SEQ ID NO: 40 - DNA, 2094 bp, synthetic construct
  source 1..2094: mol_type = other DNA
  misc_feature 1..2094: note = open reading frame
atgtttgtcttcttggtccttctgccgcttgtttcttcacaatgtgtgcgcgtgcagcccacggaatcaattgtgcggtttcccaatattacaaacttgtgccctttcggcgaggtcttcaatgcaacgcgctttgcgtcagtttacgcctggaataggaagaggatatcaaactgcgtggctgactattctgtgctttacaactctgctagtttcagtacctttaagtgttacggtgtgagtccgacgaagctcaatgatctttgtttcactaatgtatacgcggacagtttcgttatacgaggagacgaggtccggcaaatcgcacccggccaaacgggaaagattgctgactacaactacaaattgcccgatgactttacgggatgcgtcattgcatggaattctaataatctggatagcaaagtaggtggaaactataattatctctaccggctcttccgaaagagtaatctcaaaccgtttgaaagagatattagcacggaaatatatcaagccggctccacaccatgtaatggagttgaaggctttaattgttatttcccgttgcaaagttacggatttcagcccacgaacggtgtgggttatcaaccgtatcgggtcgtagttctcagcttcgagctgcttcatgcgcccgcgactgtttgcggtcctaagaagtcaaccaatctcgtaaagaacaagtgtgtgaacttcggatctggatcaggttcacgcgttcagcctacagagtcaattgtgcgatttcctaacatcactaacctgtgcccgtttggagaagtatttaatgcgactcgcttcgctagtgtctatgcgtggaatcgaaagcggatctcaaactgtgtggcagattattccgtcctgtataatagtgccagcttctcaacgtttaaatgctacggagttagcccaacgaagctgaacgacttgtgctttacgaacgtgtatgccgattccttcgtcatccgcggagacgaagttcgccaaatcgcaccaggtcaaacgggtaatatagcggactacaactacaagctgcccgacgatttcactgggtgcgtgatcgcgtggaatagtaacaacttggactccaaagtgggtggcaactacaactatctgtataggctgtttcgaaagtccaacttgaaaccgtttgaaagggatattagtacagagatctatcaagctggtagcacaccctgcaacggtgttaaaggctttaactgctactttcctttgcagagctatggatttcagcctacttatggagtcggttaccaaccttatcgcgtcgtagtactgagtttcgaactccttcatgcacccgcaactgtgtgcgggccaaagaagtctaccaatttggtcaagaataagtgtgtaaacttcggtagtggttctggtagtcgagtgcagcccacagaatccatagttcgattccctaacatcactaatttgtgtccatttggtgaagtgtttaacgcgaccaggttcgccagcgtttatgcatggaatagaaagcggatcagtaattgcgtggccgattattctgtcctgtataattcagcatccttctctactttcaagtgttatggtgtttcaccaaccaaattgaacgatctctgcttcactaatgtttatgcagacagctttgtgatacgaggagatgaggtcagacagattgctcccgggcaaacgggaaagattgctgattataactacaagctgcctgacgactttacgggctgtgtcatagcgtggaacagcaataacctcgatagtaaggtaggcggtaattacaactaccggtatagactgtttcggaagtccaatctgaagcctttcgaacgcgatattagtaccgagatctatcaggcaggttccacaccttgcaatggagtggagggctttaattgctatttccctctgcaatcctacggattccaaccaacctatggcgttggctaccagccttatcgggtggtcgtgctttcctttgaacttcttcacgcacccgctactgtatgtggccctaagaagagcactaaccttgtgaagaacaaatgcgtcaatttctaa

SEQ ID NO: 41 - protein, 16 aa, synthetic construct
  REGION 1..16: note = signal peptide of S antigen
MFVFLVLLPLVSSQCV

SEQ ID NO: 42 - protein, 6 aa, synthetic construct
  REGION 1..6: note = GS linker
GSGSGS

SEQ ID NO: 43 - protein, 697 aa, synthetic construct
  REGION 1..697: note = encoded protein
  REGION 240..245: note = MISC_FEATURE - GS linker
  REGION 1..16: note = MISC_FEATURE - signal peptide of S antigen
  REGION 469..474: note = MISC_FEATURE - GS linker
MFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFGSGSGSRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFGSGSGSRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTYGVGYQPYRVVVLSFELLHAPATVCGPKKSTNLVKNKCVNF

SEQ ID NO: 44 - DNA, 2193 bp, synthetic construct
  source 1..2193: mol_type = other DNA
  misc_feature 1..2193: note = open reading frame
atgtttgtcttcttggtccttctgccgcttgtttcttcacaatgtgtgcgcgtgcagcccacggaatcaattgtgcggtttcccaatattacaaacttgtgccctttcggcgaggtcttcaatgcaacgcgctttgcgtcagtttacgcctggaataggaagaggatatcaaactgcgtggctgactattctgtgctttacaactctgctagtttcagtacctttaagtgttacggtgtgagtccgacgaagctcaatgatctttgtttcactaatgtatacgcggacagtttcgttatacgaggagacgaggtccggcaaatcgcacccggccaaacgggaaagattgctgactacaactacaaattgcccgatgactttacgggatgcgtcattgcatggaattctaataatctggatagcaaagtaggtggaaactataattatctctaccggctcttccgaaagagtaatctcaaaccgtttgaaagagatattagcacggaaatatatcaagccggctccacaccatgtaatggagttgaaggctttaattgttatttcccgttgcaaagttacggatttcagcccacgaacggtgtgggttatcaaccgtatcgggtcgtagttctcagcttcgagctgcttcatgcgcccgcgactgtttgcggtcctaagaagtcaaccaatctcgtaaagaacaagtgtgtgaacttcggatctggatcaggttcacgcgttcagcctacagagtcaattgtgcgatttcctaacatcactaacctgtgcccgtttggagaagtatttaatgcgactcgcttcgctagtgtctatgcgtggaatcgaaagcggatctcaaactgtgtggcagattattccgtcctgtataatagtgccagcttctcaacgtttaaatgctacggagttagcccaacgaagctgaacgacttgtgctttacgaacgtgtatgccgattccttcgtcatccgcggagacgaagttcgccaaatcgcaccaggtcaaacgggtaatatagcggactacaactacaagctgcccgacgatttcactgggtgcgtgatcgcgtggaatagtaacaacttggactccaaagtgggtggcaactacaactatctgtataggctgtttcgaaagtccaacttgaaaccgtttgaaagggatattagtacagagatctatcaagctggtagcacaccctgcaacggtgttaaaggctttaactgctactttcctttgcagagctatggatttcagcctacttatggagtcggttaccaaccttatcgcgtcgtagtactgagtttcgaactccttcatgcacccgcaactgtgtgcgggccaaagaagtctaccaatttggtcaagaataagtgtgtaaacttcggtagtggttctggtagtcgagtgcagcccacagaatccatagttcgattccctaacatcactaatttgtgtccatttggtgaagtgtttaacgcgaccaggttcgccagcgtttatgcatggaatagaaagcggatcagtaattgcgtggccgattattctgtcctgtataattcagcatccttctctactttcaagtgttatggtgtttcaccaaccaaattgaacgatctctgcttcactaatgtttatgcagacagctttgtgatacgaggagatgaggtcagacagattgctcccgggcaaacgggaaagattgctgattataactacaagctgcctgacgactttacgggctgtgtcatagcgtggaacagcaataacctcgatagtaaggtaggcggtaattacaactaccggtatagactgtttcggaagtccaatctgaagcctttcgaacgcgatattagtaccgagatctatcaggcaggttccacaccttgcaatggagtggagggctttaattgctatttccctctgcaatcctacggattccaaccaacctatggcgttggctaccagccttatcgggtggtcgtgctttcctttgaacttcttcacgcacccgctactgtatgtggccctaagaagagcactaaccttgtgaagaacaaatgcgtcaatttcggatcaggaagtggatcaggttatatccctgaagcgccaagagacggacaggcttatgtcagaaaggatggtgaatgggtcttgctttcgacgttcctataa

SEQ ID NO: 45 - protein, 27 aa, synthetic construct
  REGION 1..27: note = T4 Foldon domain
GYIPEAPRDGQAYVRKDGEWVLLSTFL

SEQ ID NO: 46 - protein, 730 aa, synthetic construct
  REGION 1..730: note = encoded protein
  REGION 1..16: note = MISC_FEATURE - signal peptide of S antigen
  REGION 704..730: note = MISC_FEATURE - T4 Foldon domain
  REGION 698..703: note = MISC_FEATURE - GS linker
  REGION 240..245: note = MISC_FEATURE - GS linker
  REGION 469..474: note = MISC_FEATURE - GS linker
MFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFGSGSGSRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFGSGSGSRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTYGVGYQPYRVVVLSFELLHAPATVCGPKKSTNLVKNKCVNFGSGSGSGYIPEAPRDGQAYVRKDGEWVLLSTFL

SEQ ID NO: 47 - DNA, 2307 bp, synthetic construct
  misc_feature 1..2307: note = ORF of the RBD domain of the Wuhan-Hu-1 reference strain, the RBD domain of the B.1.351 variant, and an RBD domain combining N501Y and L452R mutations of the B.1.1.7 and B.1.429+B.1.427 variants
  source 1..2307: mol_type = other DNA
atgtttgtcttcttggtccttctgccgcttgtttcttcacaatgtgtgcgcgtgcagcccacggaatcaattgtgcggtttcccaatattacaaacttgtgccctttcggcgaggtcttcaatgcaacgcgctttgcgtcagtttacgcctggaataggaagaggatatcaaactgcgtggctgactattctgtgctttacaactctgctagtttcagtacctttaagtgttacggtgtgagtccgacgaagctcaatgatctttgtttcactaatgtatacgcggacagtttcgttatacgaggagacgaggtccggcaaatcgcacccggccaaacgggaaagattgctgactacaactacaaattgcccgatgactttacgggatgcgtcattgcatggaattctaataatctggatagcaaagtaggtggaaactataattatctctaccggctcttccgaaagagtaatctcaaaccgtttgaaagagatattagcacggaaatatatcaagccggctccacaccatgtaatggagttgaaggctttaattgttatttcccgttgcaaagttacggatttcagcccacgaacggtgtgggttatcaaccgtatcgggtcgtagttctcagcttcgagctgcttcatgcgcccgcgactgtttgcggtcctaagaagtcaaccaatctcgtaaagaacaagtgtgtgaacttcggatctggatcaggttcaggagctaccaatttcagtctactaaagcaagcgggtgatgttgaggagaatcccggacctatgttcgtgtttcttgtgttgttgccactggtttcatcccaatgtgtgcgcgttcagcctacagagtcaattgtgcgatttcctaacatcactaacctgtgcccgtttggagaagtatttaatgcgactcgcttcgctagtgtctatgcgtggaatcgaaagcggatctcaaactgtgtggcagattattccgtcctgtataatagtgccagcttctcaacgtttaaatgctacggagttagcccaacgaagctgaacgacttgtgctttacgaacgtgtatgccgattccttcgtcatccgcggagacgaagttcgccaaatcgcaccaggtcaaacgggtaatatagcggactacaactacaagctgcccgacgatttcactgggtgcgtgatcgcgtggaatagtaacaacttggactccaaagtgggtggcaactacaactatctgtataggctgtttcgaaagtccaacttgaaaccgtttgaaagggatattagtacagagatctatcaagctggtagcacaccctgcaacggtgttaaaggctttaactgctactttcctttgcagagctatggatttcagcctacttatggagtcggttaccaaccttatcgcgtcgtagtactgagtttcgaactccttcatgcacccgcaactgtgtgcgggccaaagaagtctaccaatttggtcaagaataagtgtgtaaacttcggtagtggttctggtagtggagaaggtcgtggttctctacttacgtgcggagatgttgaggagaatccaggacctatgtttgtctttctcgtacttctgcctctggtcagcagccaatgtgtgcgagtgcagcccacagaatccatagttcgattccctaacatcactaatttgtgtccatttggtgaagtgtttaacgcgaccaggttcgccagcgtttatgcatggaatagaaagcggatcagtaattgcgtggccgattattctgtcctgtataattcagcatccttctctactttcaagtgttatggtgtttcaccaaccaaattgaacgatctctgcttcactaatgtttatgcagacagctttgtgatacgaggagatgaggtcagacagattgctcccgggcaaacgggaaagattgctgattataactacaagctgcctgacgactttacgggctgtgtcatagcgtggaacagcaataacctcgatagtaaggtaggcggtaattacaactaccggtatagactgtttcggaagtccaatctgaagcctttcgaacgcgatattagtaccgagatctatcaggcaggttccacaccttgcaatggagtggagggctttaattgctatttccctctgcaatcctacggattccaaccaacctatggcgttggctaccagccttatcgggtggtcgtgctttcctttgaacttcttcacgcacccgctactgtatgtggccctaagaagagcactaaccttgtgaagaacaaatgcgtcaatttctaa

SEQ ID NO: 48 - protein, 768 aa, synthetic construct
  REGION 505..510: note = MISC_FEATURE - GS linker
  REGION 266..281: note = MISC_FEATURE - signal peptide to S antigen
  REGION 1..768: note = encoded protein sequence of the RBD domain of the Wuhan-Hu-1 reference strain, the RBD domain of the B.1.351 variant, and an RBD domain combining N501Y and L452R mutations of the B.1.1.7 and B.1.429+B.1.427 variants
  REGION 1..16: note = MISC_FEATURE - signal peptide of S antigen
  REGION 529..545: note = MISC_FEATURE - signal peptide of S antigen
  REGION 240..245: note = MISC_FEATURE - GS linker
MFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFGSGSGSGATNFSLLKQAGDVEENPGPMFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFGSGSGSGEGRGSLLTCGDVEENPGPMFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTYGVGYQPYRVVVLSFELLHAPATVCGPKKSTNLVKNKCVNF

SEQ ID NO: 49 - DNA, 2604 bp, synthetic construct
  misc_feature 1..2604: note = ORF of the RBD domain of the Wuhan-Hu-1 reference strain, the RBD domain of the B.1.351 variant, and a RBD domain combining N501Y and L452R mutations of the B.1.1.7 and B.1.429+B.1.427 variants
  source 1..2604: mol_type = other DNA
atgtttgtcttcttggtccttctgccgcttgtttcttcacaatgtgtgcgcgtgcagcccacggaatcaattgtgcggtttcccaatattacaaacttgtgccctttcggcgaggtcttcaatgcaacgcgctttgcgtcagtttacgcctggaataggaagaggatatcaaactgcgtggctgactattctgtgctttacaactctgctagtttcagtacctttaagtgttacggtgtgagtccgacgaagctcaatgatctttgtttcactaatgtatacgcggacagtttcgttatacgaggagacgaggtccggcaaatcgcacccggccaaacgggaaagattgctgactacaactacaaattgcccgatgactttacgggatgcgtcattgcatggaattctaataatctggatagcaaagtaggtggaaactataattatctctaccggctcttccgaaagagtaatctcaaaccgtttgaaagagatattagcacggaaatatatcaagccggctccacaccatgtaatggagttgaaggctttaattgttatttcccgttgcaaagttacggatttcagcccacgaacggtgtgggttatcaaccgtatcgggtcgtagttctcagcttcgagctgcttcatgcgcccgcgactgtttgcggtcctaagaagtcaaccaatctcgtaaagaacaagtgtgtgaacttcggatctggatcaggttcaggttacattccagaagcaccacgagacggtcaggcatacgtgcgtaaggacggtgagtgggtgctactaagtacattcttaggttcgggttcgggttctggagctaccaatttcagtctactaaagcaagcgggtgatgttgaggagaatcccggacctatgttcgtgtttcttgtgttgttgccactggtttcatcccaatgtgtgcgcgttcagcctacagagtcaattgtgcgatttcctaacatcactaacctgtgcccgtttggagaagtatttaatgcgactcgcttcgctagtgtctatgcgtggaatcgaaagcggatctcaaactgtgtggcagattattccgtcctgtataatagtgccagcttctcaacgtttaaatgctacggagttagcccaacgaagctgaacgacttgtgctttacgaacgtgtatgccgattccttcgtcatccgcggagacgaagttcgccaaatcgcaccaggtcaaacgggtaatatagcggactacaactacaagctgcccgacgatttcactgggtgcgtgatcgcgtggaatagtaacaacttggactccaaagtgggtggcaactacaactatctgtataggctgtttcgaaagtccaacttgaaaccgtttgaaagggatattagtacagagatctatcaagctggtagcacaccctgcaacggtgttaaaggctttaactgctactttcctttgcagagctatggatttcagcctacttatggagtcggttaccaaccttatcgcgtcgtagtactgagtttcgaactccttcatgcacccgcaactgtgtgcgggccaaagaagtctaccaatttggtcaagaataagtgtgtaaacttcggtagtggttctggtagtggatatataccggaggctcctcgtgatggacaagcctatgtacgtaaagatggagaatgggtattattgagtacgttcttaggatctggatccggatcaggagaaggtcgtggttctctacttacgtgcggagatgttgaggagaatccaggacctatgtttgtctttctcgtacttctgcctctggtcagcagccaatgtgtgcgagtgcagcccacagaatccatagttcgattccctaacatcactaatttgtgtccatttggtgaagtgtttaacgcgaccaggttcgccagcgtttatgcatggaatagaaagcggatcagtaattgcgtggccgattattctgtcctgtataattcagcatccttctctactttcaagtgttatggtgtttcaccaaccaaattgaacgatctctgcttcactaatgtttatgcagacagctttgtgatacgaggagatgaggtcagacagattgctcccgggcaaacgggaaagattgctgattataactacaagctgcctgacgactttacgggctgtgtcatagcgtggaacagcaataacctcgatagtaaggtaggcggtaattacaactaccggtatagactgtttcggaagtccaatctgaagcctttcgaacgcgatattagtaccgagatctatcaggcaggttccacaccttgcaatggagtggagggctttaattgctatttccctctgcaatcctacggattccaaccaacctatggcgttggctaccagccttatcgggtggtcgtgctttcctttgaacttcttcacgcacccgctactgtatgtggccctaagaagagcactaaccttgtgaagaacaaatgcgtcaatttcggatcaggaagtggatcaggttatatccctgaagcgccaagagacggacaggcttatgtcagaaaggatggtgaatgggtcttgctttcgacgttcctataa

SEQ ID NO: 50 - protein, 867 aa, synthetic construct
  REGION 246..272: note = MISC_FEATURE - T4 Foldon domain
  REGION 544..570: note = MISC_FEATURE - T4 Foldon domain
  REGION 1..16: note = MISC_FEATURE - signal peptide of S antigen
  REGION 299..314: note = MISC_FEATURE - signal peptide of S antigen
  REGION 571..576: note = MISC_FEATURE - GS linker
  REGION 596..611: note = MISC_FEATURE - signal peptide of S antigen
  REGION 538..543: note = MISC_FEATURE - GS linker
  REGION 240..245: note = MISC_FEATURE - GS linker
  REGION 835..840: note = MISC_FEATURE - GS linker
  REGION 1..867: note = encoded protein sequence of the RBD domain of the Wuhan-Hu-1 reference strain, the RBD domain of the B.1.351 variant, and a RBD domain combining N501Y and L452R mutations of the B.1.1.7 and B.1.429+B.1.427 variants
  REGION 273..278: note = MISC_FEATURE - GS linker
  REGION 841..867: note = MISC_FEATURE - T4 Foldon domain
MFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFGSGSGSGYIPEAPRDGQAYVRKDGEWVLLSTFLGSGSGSGATNFSLLKQAGDVEENPGPMFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFGSGSGSGYIPEAPRDGQAYVRKDGEWVLLSTFLGSGSGSGEGRGSLLTCGDVEENPGPMFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTYGVGYQPYRVVVLSFELLHAPATVCGPKKSTNLVKNKCVNFGSGSGSGYIPEAPRDGQAYVRKDGEWVLLSTFL

SEQ ID NO: 51 - DNA, 2235 bp, synthetic construct
  source 1..2235: mol_type = other DNA
  misc_feature 1..2235: note = ORF of the RBD domain of the Wuhan-Hu-1 reference strain, the RBD domain of the B.1.351 variant, and an RBD domain combining N501Y and L452R mutations of the B.1.1.7 and B.1.429+B.1.427 variants
atgtttgtcttcttggtccttctgccgcttgtttcttcacaatgtgtgcgcgtgcagcccacggaatcaattgtgcggtttcccaatattacaaacttgtgccctttcggcgaggtcttcaatgcaacgcgctttgcgtcagtttacgcctggaataggaagaggatatcaaactgcgtggctgactattctgtgctttacaactctgctagtttcagtacctttaagtgttacggtgtgagtccgacgaagctcaatgatctttgtttcactaatgtatacgcggacagtttcgttatacgaggagacgaggtccggcaaatcgcacccggccaaacgggaaagattgctgactacaactacaaattgcccgatgactttacgggatgcgtcattgcatggaattctaataatctggatagcaaagtaggtggaaactataattatctctaccggctcttccgaaagagtaatctcaaaccgtttgaaagagatattagcacggaaatatatcaagccggctccacaccatgtaatggagttgaaggctttaattgttatttcccgttgcaaagttacggatttcagcccacgaacggtgtgggttatcaaccgtatcgggtcgtagttctcagcttcgagctgcttcatgcgcccgcgactgtttgcggtcctaagaagtcaaccaatctcgtaaagaacaagtgtgtgaacttcggatctggatcaggttcacgcgttcagcctacagagtcaattgtgcgatttcctaacatcactaacctgtgcccgtttggagaagtatttaatgcgactcgcttcgctagtgtctatgcgtggaatcgaaagcggatctcaaactgtgtggcagattattccgtcctgtataatagtgccagcttctcaacgtttaaatgctacggagttagcccaacgaagctgaacgacttgtgctttacgaacgtgtatgccgattccttcgtcatccgcggagacgaagttcgccaaatcgcaccaggtcaaacgggtaatatagcggactacaactacaagctgcccgacgatttcactgggtgcgtgatcgcgtggaatagtaacaacttggactccaaagtgggtggcaactacaactatctgtataggctgtttcgaaagtccaacttgaaaccgtttgaaagggatattagtacagagatctatcaagctggtagcacaccctgcaacggtgttaaaggctttaactgctactttcctttgcagagctatggatttcagcctacttatggagtcggttaccaaccttatcgcgtcgtagtactgagtttcgaactccttcatgcacccgcaactgtgtgcgggccaaagaagtctaccaatttggtcaagaataagtgtgtaaacttcggtagtggttctggtagtcgagtgcagcccacagaatccatagttcgattccctaacatcactaatttgtgtccatttggtgaagtgtttaacgcgaccaggttcgccagcgtttatgcatggaatagaaagcggatcagtaattgcgtggccgattattctgtcctgtataattcagcatccttctctactttcaagtgttatggtgtttcaccaaccaaattgaacgatctctgcttcactaatgtttatgcagacagctttgtgatacgaggagatgaggtcagacagattgctcccgggcaaacgggaaagattgctgattataactacaagctgcctgacgactttacgggctgtgtcatagcgtggaacagcaataacctcgatagtaaggtaggcggtaattacaactaccggtatagactgtttcggaagtccaatctgaagcctttcgaacgcgatattagtaccgagatctatcaggcaggttccacaccttgcaatggagtggagggctttaattgctatttccctctgcaatcctacggattccaaccaacctatggcgttggctaccagccttatcgggtggtcgtgctttcctttgaacttcttcacgcacccgctactgtatgtggccctaagaagagcactaaccttgtgaagaacaaatgcgtcaatttcggatcaggaagtggatcatggtacatatggctagggtttatagcaggccttatagcaatcgtcatggttaccatcatgctttgctgtatgaccagttgctgctcatgcctgaagggttgttgttcctgcggatcttgctgttaa

SEQ ID NO: 52 - protein, 744 aa, synthetic construct
  REGION 240..245: note = MISC_FEATURE - GS linker
  REGION 469..474: note = MISC_FEATURE - GS linker
  REGION 698..703: note = MISC_FEATURE - GS linker
  REGION 1..16: note = MISC_FEATURE - signal peptide of S antigen
  REGION 1..744: note = encoded protein sequence of the RBD domain of the Wuhan-Hu-1 reference strain, the RBD domain of the B.1.351 variant, and an RBD domain combining N501Y and L452R mutations of the B.1.1.7 and B.1.429+B.1.427 variants
MFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFGSGSGSRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFGSGSGSRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTYGVGYQPYRVVVLSFELLHAPATVCGPKKSTNLVKNKCVNFGSGSGSWYIWLGFIAGLIAIVMVTIMLCCMTSCCSCLKGCCSCGSCC

SEQ ID NO: 53 - DNA, 2730 bp, synthetic construct
  misc_feature 1..2730: note = ORF of the RBD domain of the Wuhan-Hu-1 reference strain, the RBD domain of the B.1.351 variant, and an RBD domain combining N501Y and L452R mutations of the B.1.1.7 and B.1.429+B.1.427 variants
  source 1..2730: mol_type = other DNA
atgtttgtcttcttggtccttctgccgcttgtttcttcacaatgtgtgcgcgtgcagcccacggaatcaattgtgcggtttcccaatattacaaacttgtgccctttcggcgaggtcttcaatgcaacgcgctttgcgtcagtttacgcctggaataggaagaggatatcaaactgcgtggctgactattctgtgctttacaactctgctagtttcagtacctttaagtgttacggtgtgagtccgacgaagctcaatgatctttgtttcactaatgtatacgcggacagtttcgttatacgaggagacgaggtccggcaaatcgcacccggccaaacgggaaagattgctgactacaactacaaattgcccgatgactttacgggatgcgtcattgcatggaattctaataatctggatagcaaagtaggtggaaactataattatctctaccggctcttccgaaagagtaatctcaaaccgtttgaaagagatattagcacggaaatatatcaagccggctccacaccatgtaatggagttgaaggctttaattgttatttcccgttgcaaagttacggatttcagcccacgaacggtgtgggttatcaaccgtatcgggtcgtagttctcagcttcgagctgcttcatgcgcccgcgactgtttgcggtcctaagaagtcaaccaatctcgtaaagaacaagtgtgtgaacttcggatctggatcaggttcatggtacatctggctcggctttatagctggcctgatcgccattgtgatggtgactattatgttgtgttgcatgactagctgctgttcatgtcttaagggatgctgcagctgcggtagctgctgtggttcgggttcgggttctggagctaccaatttcagtctactaaagcaagcgggtgatgttgaggagaatcccggacctatgttcgtgtttcttgtgttgttgccactggtttcatcccaatgtgtgcgcgttcagcctacagagtcaattgtgcgatttcctaacatcactaacctgtgcccgtttggagaagtatttaatgcgactcgcttcgctagtgtctatgcgtggaatcgaaagcggatctcaaactgtgtggcagattattccgtcctgtataatagtgccagcttctcaacgtttaaatgctacggagttagcccaacgaagctgaacgacttgtgctttacgaacgtgtatgccgattccttcgtcatccgcggagacgaagttcgccaaatcgcaccaggtcaaacgggtaatatagcggactacaactacaagctgcccgacgatttcactgggtgcgtgatcgcgtggaatagtaacaacttggactccaaagtgggtggcaactacaactatctgtataggctgtttcgaaagtccaacttgaaaccgtttgaaagggatattagtacagagatctatcaagctggtagcacaccctgcaacggtgttaaaggctttaactgctactttcctttgcagagctatggatttcagcctacttatggagtcggttaccaaccttatcgcgtcgtagtactgagtttcgaactccttcatgcacccgcaactgtgtgcgggccaaagaagtctaccaatttggtcaagaataagtgtgtaaacttcggtagtggttctggtagttggtatatatggctagggttcattgctggacttatagcaattgtgatggtaacgatcatgttgtgttgcatgacttcctgctgcagttgcctcaaaggatgttgttcctgtggatcatgctgtggatctggatccggatcaggagaaggtcgtggttctctacttacgtgcggagatgttgaggagaatccaggacctatgtttgtctttctcgtacttctgcctctggtcagcagccaatgtgtgcgagtgcagcccacagaatccatagttcgattccctaacatcactaatttgtgtccatttggtgaagtgtttaacgcgaccaggttcgccagcgtttatgcatggaatagaaagcggatcagtaattgcgtggccgattattctgtcctgtataattcagcatccttctctactttcaagtgttatggtgtttcaccaaccaaattgaacgatctctgcttcactaatgtttatgcagacagctttgtgatacgaggagatgaggtcagacagattgctcccgggcaaacgggaaagattgctgattataactacaagctgcctgacgactttacgggctgtgtcatagcgtggaacagcaataacctcgatagtaaggtaggcggtaattacaactaccggtatagactgtttcggaagtccaatctgaagcctttcgaacgcgatattagtaccgagatctatcaggcaggttccacaccttgcaatggagtggagggctttaattgctatttccctctgcaatcctacggattccaaccaacctatggcgttggctaccagccttatcgggtggtcgtgctttcctttgaacttcttcacgcacccgctactgtatgtggccctaagaagagcactaaccttgtgaagaacaaatgcgtcaatttcggatcaggaagtggatcatggtacatatggctagggtttatagcaggccttatagcaatcgtcatggttaccatcatgctttgctgtatgaccagttgctgctcatgcctgaagggttgttgttcctgcggatcttgctgttaa

SEQ ID NO: 54 - protein, 909 aa, synthetic construct
  REGION 1..909: note = encoded protein sequence of the RBD domain of the Wuhan-Hu-1 reference strain, the RBD domain of the B.1.351 variant, and an RBD domain combining N501Y and L452R mutations of the B.1.1.7 and B.1.429+B.1.427 variants
  REGION 863..868: note = MISC_FEATURE - GS linker
  REGION 240..245: note = MISC_FEATURE - GS linker
  REGION 624..639: note = MISC_FEATURE - signal peptide of S antigen
  REGION 599..604: note = MISC_FEATURE - GS linker
  REGION 287..292: note = MISC_FEATURE - GS linker
  REGION 313..328: note = MISC_FEATURE - signal peptide of S antigen
  REGION 552..557: note = MISC_FEATURE - GS linker
  REGION 1..16: note = MISC_FEATURE - signal peptide of S antigen
MFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFGSGSGSWYIWLGFIAGLIAIVMVTIMLCCMTSCCSCLKGCCSCGSCCGSGSGSGATNFSLLKQAGDVEENPGPMFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFGSGSGSWYIWLGFIAGLIAIVMVTIMLCCMTSCCSCLKGCCSCGSCCGSGSGSGEGRGSLLTCGDVEENPGPMFVFLVLLPLVSSQCVRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTYGVGYQPYRVVVLSFELLHAPATVCGPKKSTNLVKNKCVNFGSGSGSWYIWLGFIAGLIAIVMVTIMLCCMTSCCSCLKGCCSCGSCC

SEQ ID NO: 55 - DNA, 1260 bp, synthetic construct
  misc_feature 203: note = lysine
  source 1..1260: mol_type = other DNA
  misc_feature 1..1260: note = ORF of a codon-optimized N antigen that includes the N-specific mutations in the B.1.1.7 variant
  misc_feature 235: note = phenylalanine
  misc_feature 3: note = leucine
  misc_feature 204: note = arginine
atgtctctaaacggaccacagaatcagcgaaacgcaccacgcattacgtttggtggaccctcagattcaactggcagtaaccagaatggagaacgcagtggagcgcgatctaaacaacgtcggcctcaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaagatgaaagatctcagtccaagatggtatttctactacctaggaactgggccagaagctggacttccctatggtgctaacaaagacggcatcatatgggttgcaactgagggagccttgaatacacctaaagatcacattggcacccgcaatcctgctaacaatgctgcaatcgtgctacaacttcctcaaggaacaacattgcctaaaggcttctacgcagaagggagcagaggcggcagtcaagcctcttctcgttcctcatcacgtagtcgcaacagttcaagaaattcaactccaggcagcagtaaacgaacttctcctgctagaatggctggcaatggcggtgatgctgctcttgctttgctgctgcttgacagattgaaccagcttgagagcaagatgttcggtaaaggccaacaacaacaaggccaaactgtcactaagaaatctgctgctgaggcttctaagaagcctcggcagaaacgtactgccactaaagcatacaatgtaacacaagctttcggcagacgtggtccagaacaaacccaaggaaactttggagaccaggaactaatcagacaaggaactgattacaaacattggccgcaaattgcacaatttgctcccagcgcttcagcgttcttcggaatgtcgcgcattggcatggaagtcacaccttcgggaacgtggttgacctacacaggtgccatcaaattggatgacaaagatccaaatttcaaagatcaagtcatattgctgaataagcatattgacgcatacaagacattcccaccaacagagcctaagaaggacaagaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaa

SEQ ID NO: 56 - protein, 419 aa, synthetic construct
  REGION 1..419: note = encoded protein sequence of a codon-optimized N antigen that includes the N-specific mutations in the B.1.1.7 variant
  SITE 235: note = MISC_FEATURE - phenylalanine
  SITE 203: note = MISC_FEATURE - lysine
  SITE 3: note = MISC_FEATURE - leucine
  SITE 204: note = MISC_FEATURE - arginine
MSLNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSKRTSPARMAGNGGDAALALLLLDRLNQLESKMFGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 57 - DNA, 1260 bp, synthetic construct
  misc_feature 205: note = isoleucine
  source 1..1260: mol_type = other DNA
  misc_feature 1..1260: note = ORF of a codon-optimized N antigen that includes the N-specific mutations in the B.1.351 variant
atgtctgataacggaccacagaatcagcgaaacgcaccacgcattacgtttggtggaccctcagattcaactggcagtaaccagaatggagaacgcagtggagcgcgatctaaacaacgtcggcctcaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaagatgaaagatctcagtccaagatggtatttctactacctaggaactgggccagaagctggacttccctatggtgctaacaaagacggcatcatatgggttgcaactgagggagccttgaatacacctaaagatcacattggcacccgcaatcctgctaacaatgctgcaatcgtgctacaacttcctcaaggaacaacattgcctaaaggcttctacgcagaagggagcagaggcggcagtcaagcctcttctcgttcctcatcacgtagtcgcaacagttcaagaaattcaactccaggcagcagtagaggaatctctcctgctagaatggctggcaatggcggtgatgctgctcttgctttgctgctgcttgacagattgaaccagcttgagagcaagatgtctggtaaaggccaacaacaacaaggccaaactgtcactaagaaatctgctgctgaggcttctaagaagcctcggcagaaacgtactgccactaaagcatacaatgtaacacaagctttcggcagacgtggtccagaacaaacccaaggaaactttggagaccaggaactaatcagacaaggaactgattacaaacattggccgcaaattgcacaatttgctcccagcgcttcagcgttcttcggaatgtcgcgcattggcatggaagtcacaccttcgggaacgtggttgacctacacaggtgccatcaaattggatgacaaagatccaaatttcaaagatcaagtcatattgctgaataagcatattgacgcatacaagacattcccaccaacagagcctaagaaggacaagaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaa

SEQ ID NO: 58 - protein, 419 aa, synthetic construct
  REGION 1..419: note = encoded protein sequence of a codon-optimized N antigen that includes the N-specific mutations in the B.1.351 variant
  SITE 205: note = MISC_FEATURE - isoleucine
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGISPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 59 - DNA, 1260 bp, synthetic construct
  misc_feature 1..1260: note = ORF of a codon-optimized N antigen that includes the N-specific mutations in the P.1 variant
  misc_feature 80: note = arginine
  source 1..1260: mol_type = other DNA
atgtctgataacggaccacagaatcagcgaaacgcaccacgcattacgtttggtggaccctcagattcaactggcagtaaccagaatggagaacgcagtggagcgcgatctaaacaacgtcggcctcaaggtttacccaataatactgcgtcttggttcaccgctctcactcaacatggcaaggaagaccttaaattccctcgaggacaaggcgttccaattaacaccaatagcagtcgagatgaccaaattggctactaccgaagagctaccagacgaattcgtggtggtgacggtaagatgaaagatctcagtccaagatggtatttctactacctaggaactgggccagaagctggacttccctatggtgctaacaaagacggcatcatatgggttgcaactgagggagccttgaatacacctaaagatcacattggcacccgcaatcctgctaacaatgctgcaatcgtgctacaacttcctcaaggaacaacattgcctaaaggcttctacgcagaagggagcagaggcggcagtcaagcctcttctcgttcctcatcacgtagtcgcaacagttcaagaaattcaactccaggcagcagtaaacgaacttctcctgctagaatggctggcaatggcggtgatgctgctcttgctttgctgctgcttgacagattgaaccagcttgagagcaagatgtctggtaaaggccaacaacaacaaggccaaactgtcactaagaaatctgctgctgaggcttctaagaagcctcggcagaaacgtactgccactaaagcatacaatgtaacacaagctttcggcagacgtggtccagaacaaacccaaggaaactttggagaccaggaactaatcagacaaggaactgattacaaacattggccgcaaattgcacaatttgctcccagcgcttcagcgttcttcggaatgtcgcgcattggcatggaagtcacaccttcgggaacgtggttgacctacacaggtgccatcaaattggatgacaaagatccaaatttcaaagatcaagtcatattgctgaataagcatattgacgcatacaagacattcccaccaacagagcctaagaaggacaagaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaa

SEQ ID NO: 60 - protein, 419 aa, synthetic construct
  REGION 1..419: note = encoded protein sequence of a codon-optimized N antigen that includes the N-specific mutations in the P.1 variant
  SITE 80: note = MISC_FEATURE - arginine
MSDNGPQNQRNAPRITFGGPSDSTGSNQNGERSGARSKQRRPQGLPNNTASWFTALTQHGKEDLKFPRGQGVPINTNSSRDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSKRTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 61 - DNA, 3822 bp, synthetic construct
  source 1..3822: mol_type = other DNA
  misc_feature 1..3822: note = ORF of the codon-optimized SARS-CoV-2 S antigen based on the Wuhan-Hu-1 reference strain
atgtttgtctttcttgtcttattgccactagtctctagtcagtgtgttaatcttacaaccagaactcaattaccacctgcatacactaattctttcacacgtggtgtttattaccctgacaaagtattcagatcctcagtattacattcaactcaggacttgttcttacctttcttctccaatgttacttggttccatgctatacatgtctctgggaccaatggtactaagaggtttgataaccctgtcctaccatttaatgatggtgtttatttcgcttccactgagaagtctaacataataagaggctggatatttggtactactttagattcgaagacccagtccctacttattgttaataacgctactaatgttgttattaaagtctgtgaatttcaattctgtaatgatccattcttggatgtttattaccacaagaacaacaagagttggatgaagagtgagttcagagtttattctagtgcgaataattgcactttcgaatatgtctctcagcctttccttatggaccttgaaggtaaacagggtaatttcaagaatcttagggaatttgtgtttaagaatattgatggttatttcaagatatattctaagcacacgcctattaatttagtgcgtgatctccctcagggtttctcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggactttcctattgaaatataatgagaatggaaccattacagatgctgtagactgtgcacttgaccctctctcagaaacaaagtgtacgttgaaatccttcactgtagagaaaggaatctatcaaacttctaactttagagtccaaccaacagaatctattgttagatttcctaatattacaaacttgtgccctttcggtgaagtatttaacgccaccagatttgcatctgtttatgcttggaacaggaagagaatcagcaactgtgttgctgattattctgtcctatataattccgcatcattctccacatttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgactttacaggctgcgttatagcttggaattctaacaatcttgattctaaggttggtggtaattataattaccggtatagattgtttaggaagtctaatctcaaacctttcgagagagatatttcaactgaaatctatcaggccggtagcacaccttgtaatggtgttcaaggatttaattgttactttcctttacaatcatatggtttccaacccactaatggtgttggttaccaaccatacagagtagtagtactttcatttgaacttctacatgcaccagcaactgtttgtggacctaagaagtctactaatttggttaagaacaaatgtgtcaatttcaacttcaatggtttaacaggcacaggtgttcttactgagtctaacaagaagtttctgcctttccaacaatttggcagagacattgctgacactactgatgctgtccgtgatccacagacacttgagattcttgacattacaccatgttcatttggtggtgtcagtgttataacaccaggaacaaatacttctaaccaggttgctgttctttatcagggtgttaactgcacagaagtccctgttgctattcatgcagatcaacttactcctacttggcgtgtttattctacaggttctaatgtatttcaaacacgtgcaggctgtttaataggagctgaacatgtcaacaactcatatgagtgtgacatacccattggtgcaggtatatgcgctagttatcagactcagactaattctcgtcggcgggcacgtagtgtagctagtcaatccatcattgcctacactatgtcacttggtgcagagaattcagttgcttactctaataactctattgccatacccacaaactttactattagtgttaccacagaaattctaccagtgtctatgaccaagacatcagtagattgtacaatgtacatttgtggtgattcaactgaatgcagcaatctattgttgcaatatggcagtttctgtacacaattaaaccgtgctttaactggaatagctgttgaacaagacaagaacacccaagaagtatttgcacaagtcaaacaaatttacaagacaccaccaattaaagatttcggtggatttaatttctcacaaatattaccagatccatctaaaccaagcaagaggtcatttattgaagatctactattcaacaaagtgacacttgcagatgctggcttcatcaaacaatatggtgattgccttggtgatattgctgctagagacctcatttgtgcacagaagtttaacggccttactgtattgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccagaaattgattgccaaccaatttaatagtgctattggcaagattcaagactcactttcttccacagcaagtgcacttggtaaacttcaagatgtggtcaaccagaatgcacaagctttaaacacgcttgttaaacaacttagctccaactttggtgcaatttcaagtgtattaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaagatgtcagagtgtgtacttggacaatctaagagagttgatttctgtggaaagggctatcatcttatgtccttccctcagtcagcacctcatggtgtagtcttcttgcatgtgacttatgtccctgcacacgagaagaacttcacaactgctcctgccatttgtcatgatggtaaagcacactttcctcgtgaaggtgtctttgtttcaaatggcacagactggtttgtaacacaaaggaatttctatgaaccacaaatcattactacagacaacacatttgtgtctggtaactgtgatgttgtaataggaattgtcaacaacacagtttatgatcctttgcaacctgaattagactcattcaaggaggagttagataaatatttcaagaatcatacatcaccagatgttgatttaggtgacatctctggcattaatgcttcagttgtaaacattcagaaagaaattgaccgcctcaatgaggttgccaagaatttaaatgaatctctcatcgatctccaagaacttggaaagtatgagcagtatatcaaatggccatggtacatttggctaggtttcatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 62 - protein, 1273 aa, synthetic construct
  SITE 142: note = MISC_FEATURE - aspartic acid
  SITE 681: note = MISC_FEATURE - lysine
  SITE 1071: note = MISC_FEATURE - histidine
  REGION 1..1273: note = encoded protein sequence of the codon-optimized SARS-CoV-2 S antigen sequence based on the Wuhan-Hu-1 reference strain
  REGION 1..16: note = MISC_FEATURE - signal peptide of S antigen
  SITE 1101: note = MISC_FEATURE - histidine aspartic acid
  SITE 154: note = MISC_FEATURE - lysine
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWMKSEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVQGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAHEKNFTTAPAICHDGKAHFPREGVFVSNGTDWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 63 - DNA, 1260 bp, synthetic construct
  source 1..1260: mol_type = other DNA
  misc_feature 1..1260: note = ORF of the codon-optimized SARS-CoV-2 N antigen of B.1.617 variant
atgtctgataacggaccacagaatcagcgaaacgcaccacgcattacgtttggtggaccctcagattcaactggcagtaaccagaatggagaacgcagtggagcgcgatctaaacaacgtcggcctcaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaagatgaaagatctcagtccaagatggtatttctactacctaggaactgggccagaagctggacttccctatggtgctaacaaagacggcatcatatgggttgcaactgagggagccttgaatacacctaaagatcacattggcacccgcaatcctgctaacaatgctgcaatcgtgctacaacttcctcaaggaacaacattgcctaaaggcttctacgcagaagggagcagaggcggcagtcaagcctcttctcgttcctcatcacgtagtcgcaacagttcaagaaattcaactccaggcagcagtatgggaacttctcctgctagaatggctggcaatggcggtgatgctgctcttgctttgctgctgcttgacagattgaaccagcttgagagcaagatgtctggtaaaggccaacaacaacaaggccaaactgtcactaagaaatctgctgctgaggcttctaagaagcctcggcagaaacgtactgccactaaagcatacaatgtaacacaagctttcggcagacgtggtccagaacaaacccaaggaaactttggagaccaggaactaatcagacaaggaactgattacaaacattggccgcaaattgcacaatttgctcccagcgcttcagcgttcttcggaatgtcgcgcattggcatggaagtcacaccttcgggaacgtggttgacctacacaggtgccatcaaattggatgacaaagatccaaatttcaaagatcaagtcatattgctgaataagcatattgacgcatacaagacattcccaccaacagagcctaagaaggacaagaagaagaaggcttatgaaactcaagccttaccgcagagacagaagaaacagcaaactgtgactcttcttcctgctgcagatttggatgatttctccaaacaattgcaacaatccatgagcagtgctgactcaactcaggcctaa

SEQ ID NO: 64 - protein, 419 aa, synthetic construct
  SITE 203: note = MISC_FEATURE - methionine
  REGION 1..419: note = encoded protein sequence of the codon-optimized SARS-CoV-2 N antigen sequence of the B.1.617 variant
  SITE 377: note = MISC_FEATURE - tyrosine
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSMGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKAYETQALPQRQKKQQTVTLLPAADLDDFSKQLQQSMSSADSTQA

SEQ ID NO: 65 - protein, 19 aa, synthetic construct
  REGION 1..19: note = SARS-CoV-2 S antigen
KFDEDDSEPVLKGVKLHYT

SEQ ID NO: 66 - DNA, 215 bp, synthetic construct
  misc_feature 196..215: note = CR/HL/CR
  source 1..215: mol_type = other DNA
  misc_feature 1..20: note = CR/HL/CR
  misc_feature 1..215: note = CR/HL/CR
  misc_feature 25..190: note = duplex copy of MVA terminal HL
tttttttctagacactaaataaatagtaagattaaattaattataaaattatgtatataatattaattataaaattatgtatatgatttactaactttagttagataaattaataatacataaattttagtatattaatattataaattaataatacataaattttagtatattaatattatattttaaatatttatttagtgtctagaaaaaaa

SEQ ID NO: 67 - skipped

SEQ ID NO: 68 - DNA, 73 bp, synthetic construct
  misc_feature 1..73: note = primer
  source 1..73: mol_type = other DNA
aaaaaatatattatttttatgttattttgttaaaaataatcatcgaatacgaactagtataaaaaggcgcgcc

SEQ ID NO: 69 - DNA, 77 bp, synthetic construct
  source 1..77: mol_type = other DNA
  misc_feature 1..77: note = primer
gaagataccaaaatagtaaagattttgctattcagtggactggatgattcaaaaattgaaaataaatacaaaggttc

SEQ ID NO: 70 - DNA, 80 bp, synthetic construct
  misc_feature 1..80: note = primer
  source 1..80: mol_type = other DNA
atatgaatatgatttcagatactatatttgttcctgtagataataactaaaaatttttatctagtataaaaaggcgcgcc

SEQ ID NO: 71 - DNA, 80 bp, synthetic construct
  misc_feature 1..80: note = primer
  source 1..80: mol_type = other DNA
ggaaaatttttcatctctaaaaaaagatgtggtcattagagtttgatttttataaaaattgaaaataaatacaaaggttc

SEQ ID NO: 72 - DNA, 79 bp, synthetic construct
  misc_feature 1..79: note = primer
  source 1..79: mol_type = other DNA
ttggggaaatatgaacctgacatgattaagattgctctttcggtggctggtaaaaaattgaaaataaatacaaaggttc

SEQ ID NO: 73 - DNA, 70 bp, synthetic construct
  misc_feature 1..70: note = primer
  source 1..70: mol_type = other DNA
acaaaattatgtattttgttctatcaactacctataaaactttccaaatactagtataaaaaggcgcgcc

SEQ ID NO: 74 - DNA, 44 bp, synthetic construct
  source 1..44: mol_type = other DNA
  misc_feature 1..44: note = primer
  misc_feature 21: note = n is a, c, g, or t
tcgtggtgtgcctgaatcgandaggtagcgacttcaggtttctt

SEQ ID NO: 75 - DNA, 43 bp, synthetic construct
  source 1..43: mol_type = other DNA
  misc_feature 22: note = n is a, c, g, or t
  misc_feature 1..43: note = primer
tatccaccaatccgagaccaandcctctggaccgcataatctg

SEQ ID NO: 76 - DNA, 51 bp, synthetic construct
  source 1..51: mol_type = other DNA
  misc_feature 1..51: note = primer
  misc_feature 26: note = n is a, c, g, or t
aggtttgatcgttgtcatttctccandagagggatattaagtcgatagccg

SEQ ID NO: 77 - DNA, 19 bp, synthetic construct
  misc_feature 1..19: note = primer
  source 1..19: mol_type = other DNA
tggaatgcgttccttgtgc

SEQ ID NO: 78 - DNA, 21 bp, synthetic construct
  misc_feature 1..21: note = primer
  source 1..21: mol_type = other DNA
cgtttttcccattcgatacag

SEQ ID NO: 79 - DNA, 23 bp, synthetic construct
  source 1..23: mol_type = other DNA
  misc_feature 1..23: note = primer
tatagtctttgtggcatccgttg

SEQ ID NO: 80 - DNA, 23 bp, synthetic construct
  source 1..23: mol_type = other DNA
  misc_feature 1..23: note = primer
acccaaactttagtaaggccatg

SEQ ID NO: 81 - DNA, 20 bp, synthetic construct
  misc_feature 1..20: note = primer
  source 1..20: mol_type = other DNA
ataagcgttgtcaaagcggg

SEQ ID NO: 82 - DNA, 23 bp, synthetic construct
  source 1..23: mol_type = other DNA
  misc_feature 1..23: note = primer
aggaaatagaaattgttggtgcg

SEQ ID NO: 83 - DNA, 23 bp, synthetic construct
  misc_feature 1..23: note = primer
  source 1..23: mol_type = other DNA
acattggcggacaatctaaaaac

SEQ ID NO: 84 - DNA, 25 bp, synthetic construct
  source 1..25: mol_type = other DNA
  misc_feature 1..25: note = primer
atcatcggtggttgatttagtagtg

SEQ ID NO: 85 - DNA, 20 bp, synthetic construct
  misc_feature 1..20: note = primer
  source 1..20: mol_type = other DNA
tatccaccaatccgagacca

SEQ ID NO: 86 - DNA, 25 bp, synthetic construct
  source 1..25: mol_type = other DNA
  misc_feature 1..25: note = primer
gtctgtccgtcttctctattgttta

SEQ ID NO: 87 - DNA, 25 bp, synthetic construct
  misc_feature 1..25: note = primer
  source 1..25: mol_type = other DNA
ttaactcagtttcaatacggtgcag

SEQ ID NO: 88 - DNA, 22 bp, synthetic construct
  misc_feature 1..22: note = primer
  source 1..22: mol_type = other DNA
tggggtttcttctcaggctatc

SEQ ID NO: 89 - protein, 15 aa, synthetic construct
  REGION 1..15: note = peptide N26
MKDLSPRWYFYYLGT

SEQ ID NO: 90 - protein, 9 aa, synthetic construct
  REGION 1..9: note = HLA-B*0702 immunodominant N-specific peptide epitope
SPRWYFYYL

SEQ ID NO: 91 - DNA, 177923 bp, Vaccinia virus
  source 1..177923: mol_type = other DNA
gtaagattaaattaattataaaattatgtatataatattaattataaaattatgtatatgatttactaactttagttagataaattaataatacataaattttagtatattaatattataaattaataatacataaattttagtatattaatattatattttaaatatttatttagtgtctagaaaaaaatgtgtgaccaacgaccgtaggaaactctagagggtaagaaaaatcaatcgctttatagagaccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcgaaggagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagaataaaaatattttagtgacaccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcgaagagagaaagagataaaacttttttacgactccatcagaaagaggtttaatatttttgtgagaccatcgaagagagaaagagataaaacttttttacgactccatcagaaagaccatcgaagagagaaagagaaagagatagttagtctagatatttttcttagtacaaaagtcaatgttttaaaatatatggacaagaatttgtctgtataaaaacttgtgtgaaattttgtaccaaagaaaaaatgtgagcagtatcccctacatggattttactagatcatttatataccaaaaaatattatacgatctacgttttattatatgattttaacgtgtaaattataaacattattttatgatatacaattgtctggtaacctagatgggcataggggatgagtatatgttgttggacgttattgtttaagaaatagttgatgcatcagaaagaggtttaatatttttgtgagaccatcgaagagagaaagagataaaacttttttacgactccatcagaaagaggtttaatatttttgtgagaccatcgaagagagaaagagataaaacttttttatgactccattgaagagagaatgagaataaaaatattttagtgacaccatcagaaagaggtttaatattttttatgagaccatcaaagagagaaagagaataaaaatattttatgactccattgaagagagaaagagaaaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatattttatgactccattgaagagagaaagagaataaaaatattttagtgacaccatcagaaagaggtttaatatttttgtgagaccatcgaagagagaaagagaataaaaatattttatgactccattgaagagagaaagagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaaagagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaaattataaacattattttatgatatacaattgtctggtaacctagatgggcataggggatgttgataagctcgacgagtatatgttgttggacgttattgtttaagaaatagttgatgcatcagaaagagaataaaaaatattttagtgagaccatcgaagagagaaagagataaaacttttttacgactccatcagaaagaggtttaatatttttgtgagaccatcgaagagagaaagagataaaacttttttacgactccatcagaaagaggtttaatatttttgtgagaccatcgaaggagaaagagataaaacttttttacgactccatcagaaagaggtttaatatttttgtgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaaagagaataaaaatattttagtgacaccatcagaaagaggtttaatattttttatgagaccatcaaagagagaaagagaataaaaatatttttgtaaaactttttttatgagaccatcaaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaatgagaataaaaatattttagtgacaccatcagaaagaggtttaatatttttgtgagaccatcgaagagagaaagagaataaaaatattttatgactccattgaagagagaatgagaataaaaatattttagtgacaccatcagaaagaggtttaatattttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtaaaactttttttatgagaccatcaaagagagaaagagaataaaaatatttttgtgagaccatcaaagagagaaagagaataaaaatatttttgtgagaccatcaaagagagaaagagaataaaaatatttttgtgagaccatcaaagagagaaagagaataaaaatattttatgactccattgaagagagaaagagaataaaaatattttagtgacaccatcagaaagaggtttaatatttttgtgagaccatcgaagagagaaagagaataaaaatattttatgactccattgaagagagaaagagaataaaaatattttagtgacaccatcagaaagaggtttaatattttttatgagaccatcaaagagagaaagagaataaaaatattttttatgagaccatcaaagagagaaagagaataaaaatattttatgagaccatcaaagagagaaagagaataaaaatattttttatgagaccatcaaagagagaaagagaataaaaatattttatgagaccatcaaagagagaaagagaataaaaatattttttatgagaccatcaaagagagaaagagaataaaaatatttttgtatgagaccatcagaaagaggtttaatatttttgtgataccctgaaaggaaataggaatagtgtcataatcgtatcacactattgagacagaaaaagaagaagtcgcgagaggtaactttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttccatcagcggattctgagatggatttaatctgaggacatttggtgaatccaaagttcattctcagacctccaccgatgatggagtaataagtggtaggaggatctacatcctcgactgattccacctcgggatctggatctgactcggactctgtaatttccgttacggattggcaaatcttatcatcggtcggtgtttggtcttgctttgtgactttgataataacatcgattcccatatgatgtttgttttcttcttccgtacacgatgaggatgattgctgaagactggcaggcacatgcatgccagtacgatatattgtttcatgattgctattgattgagtactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctacattacccacatgataagagattgtatcagtttcgtagtcttgagtattggtattactatatagtatatagatgtcgacgctagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaagacgggatcgcagtctttatgattcatagtaatagttagttccgacgttgagatggattcgctgagaccggtagtggtcgtccgagtacacgatgtgtcgttaactggatacaggttaatttccacatcgatatagttaaaggtatttctgggtacgggttcgcatttatctgcggaagagacggtgtgagaatatgttccgagaccacacggagaacagatgacgtctccggatactccgtatcctattccacattttgtttgggaaacacatgccttgcatccatgatcgggagagcattcacagattctattgtgagtcgtgttacacgatcgcgtcgacattgttgacagaaacgtgaccttcattcttaccgtcgtccataaatacgttaggtatgtaccacatactgtcgcgaacgatgcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgccatggaaacaggacattatcactccatgataaattatttaatggagtcgatcctctcattgttctttgcgtatctcaatctgtggcgtttgcttcgtttaaataatatatcaaacatggagacgcctgatatgtaggcattcttcattctattaatgtctgctctatagcgctttagttccttatgacgaccggcgatatcatacttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactagcttctctttggtaactgcttttctggatggccgtattgattatcgagcgtgacactcgctccatattccaataaccgctttgcaaattgtatattattgacatcgaccgcgtaatatagtagagttatcgatcatatctatatcatccatgtacttgcttagtatatcaaatacatcttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagttgttgtccgtcgtcttatccaacatgcattgaatgataggtatacttaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataatctctatatctatggttgagcaagaccagtagtattggatggaaacattgttatcgatcaaacatttaattacatccttggatagagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgaaatcatttatattcgacttgagttcgttagaggaattcgaatagctggatatcagtagatgcacaatctgagattttacgtatctatgcttactgtatgctcctagcggagttaatccttcgttgtttctacaaagtctctcgactccgcgagagagtaacagtcgaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatacatgtgcaatccatagctattctggtgctaattattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctaaatttcagtttatgtttgtaccccgtattcatacttaacaaattggtattacataccattaataatgcaagcataaaaaatcgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacaaaatccatcaaaaatgttgataaattatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattattacgtgttgtctattatctgtttataggttcactcgacgaactaaactacctatacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccgtttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggccttgtatacataataataagttgtggtagtatgatctccatatttataatttaggactttgtattcagtttttttggaatcataaaaaataaaaaaaagttttactaatttaaaattatttacatttttttcactgtttagtcgcggatatggaattcgatcctgccaaaatcaatacatcatctatagatcatgtaacaatattacaatacatagatgaaccaaatgatataagactaacagtatgcattatcacaaaaataaatccacatttggctaatcaatttcgggcttggaaaaaacgtatcgccggaagggactatatgactaacttatctagagatacaggaatacaacaatcaaaacttactgaaactgtcaaaaaaatagaaacatatatggtctatatatacactacaatttagttattaattggataaccgatgtgattatcaatcaatattaagaaggttggtaaattggtacatagctaataatacctatacacccaataatacaacaaccatttctgagttggatatcatcaaaatactggataaatacgaggacgtgtatagagtaagtaaagaaaaagaatgtgaaatttgctatgaagttgtttactcaaaacgatagatactttggtttattggattcgtgtaatcatatattttgcataacatgcatcaatatatggcatagaacacgaagagaaaccggtgcgtcggataattgtcctatatgtcgtacccgttttagaaacataacaatgagcaagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacgcactacttcagccaaatattcttttttgaaacgccatctatcgtagtgaggacacaagtgaacctataatgagcaaatttattagtatcggttacatgaaggactttacgtagagtggtgattccactatctgtggtacgaacggtttcatcttctttgatgccatcacccagatgttctataaacttggtatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattttcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattgacatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgcggctttccattttccaaaaacaatttgaccaaatctacatctttattgtatctataatcactatttagataatcagccataattactcgagtgcaacatgttagatcgtctatatatgaataagccgtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataatttcaggaacaggatcatctgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatgataaagtatactacatccatgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaattgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgagtatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctcgttttgttagatgtttgcatcgtgctttaacatcaatggtacaaattttatcctcgctttgtgtatcatattcgtccctactataaaattgtatattcagattatcatgagatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttatcaaatggttgataatatggatcctcatgacaatttccgaagatggaaatgagatatagacatgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaagagttcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataacacacatgtcttaaagtttattaattaattacatgttgttttatatatcgctacgaatttaaacagagaaatcagtttaggaaaaaaaaatatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctctatatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagattaatggtgtgatgttgattaggtcttttacgaatttgatatagaatagcgtttacatattctccataatggtcaatcgccatttgttcgtatgtcataaattctttaattatatgacactgtgtattatttagttcatccttgttcatcattaggaatctatccaatatggcaattatactagaactataggtgcgttgtatacacatattgatgtgtctgtttatacaatccatgctactaccttcgggtaaaattgtagcatcatataccatttctagtactttaggttcattgttatccattgcagaggacgtcatgatcgcatcctaaaaaaatatattatttttatgttattttgttaaaaataatcatcgaatacgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgcatctttgctagagagaaagcttttcagctgcttagacttccaagtattaattcgtgacagatccatgtctgaaacgagacgctaattagtgtataatttttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattctaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggtagacgctgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcgcccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttctaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatctcattgtttgttccctggagtatgagagtcggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttatgaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaggataaagtttatacaagtgtagatgataaattctacagaggttaatatagaagcacgtaataaattgacgacgttatgactatctatatatacctttccagtatatgagtaaataactatagaagttagactgtgaatgtcaaggtctagacaaaccctcgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctaaagaaaaatgattatcttcttgagacataactcccattttttggtattcacccacacgtttttcgaaaaaattagttttaccttctaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggataccgcatctgttataatagatctaacggtttcttcactcggtggatgcaataaatgtttaaacatcaaacatgcgaagtcgcagtgtagaccctcgtctctactaatcaattcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggatcttttgtacatcgatatcgccgcaatcactacaataattacaagtattattgatagcattgttattagtactatcataattaaattatcgttattatcattttgtaattgtgacatcatactagataaatcgtttgcgagattgttgtgggaagcgggcatggaggatgaattatcgttattattatttaaagcctcccattcggattcacaaatatggcgcgcgttcaacattttatggaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatacgattagtaatgaccattaaaataaaaatattcttcataaccggcaagaaagtgaaaagttcacattgaaactatgtcagtagtatacatcatgaaatgatgatatatatatactctattttggtggaggattatatgatataattcgtggataatcattcttaagacacatttcttcattcgtaaatcttttcacgttaaatgagtgtccatattttgcaatttcttcatatgatggcggtgtacgtggacgaggctgctcctgttcttgttgtagtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatccaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctagctcggtatctactttatctgccgaatacagtgctaggggaaaaattataatatttcctctttcgtattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgatagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgatggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttggtaatgaaattattcacaatatcagtatcttctttatctaccagagattttactaacttgataaccttggctgtctcattcaatagggtagtaatatttgtatgtgtgatattgatatcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggttatgttatatgtaacattgagtaaatccttaagttcataatcatcactgtcatcagttatgtacgatccaaacaatgtttctactggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgtaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtataaaacaacgaaattatactagagttgttaaagttaatattttctatgagctgttccaataaattatttgttgtaactgcgttcaagtcataaatcatcttgatactatccagtaaaccgtttttaagttctggaatattattatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagagaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccggatacgtggatatcatatatggtattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctataatcgttaaattttacaaatctataacatgctaaaccttttgacgacaaccattcattaatttctgatatggaatctgtattctcaataccgtatcgttctaaagccagtgctatatctccctgttcgtgagaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatattgtaatattcatcatcgacataacactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctatacgtttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagccgacttgagtttatcaataactacatcagtgtctagatctctagaatatcccaataggtgttccggagaatcagtaaagaacactccacctataggattcttaatatgatacgcagtgctaactggcagacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcattatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccggtgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatcattttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattacatgttttcatattcattaggattattaaatctttaatcttactacgattgtatgcgttgatattgcaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgttttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaaaatacaattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtaataaattttattagaaatgccaaatctataagaaaagtcctcgaattagtttgaagaatatctatatcgccgtaccgtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctcaacacaaactttttcacagagcgatagagtttttgataactcgtttttcttaagaaatataaaactactgtctccagagctcgctctatcttttattttatttaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttggttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtatttcgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatatctacacaggcataaaatgtaggagagttactaggccccactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactaatttattttatcatttttttattcatcatcctctggtggttcgtcgtttctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaatttcataatgagtggaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggaaaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatagtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattacctgcatcttattagaatattaacctaactaaaagacataacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattcccgtatatgaagaaaaagtaaatactgaattcattgctaatggatcgttctctggtagatacgtatcatatcttcgaaagttttctgcccttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacatgatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtaactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagtcagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtaactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaatcttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacagcaatttctttattctctacagatgtaagatacttgaagacattcctatgatgatgcagaattttggataacacggtattgatggtatctgttaccataattcctttgatggctgatagtgtcagagcacaagatttccaatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctacaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattcctttttgcctgtatcatccagttttccatcctttgtaaagaaattattttctactagactattaataagactgataaggattcctccataattgcacaatccaaactttttaacaaaactagactttacaagatctacaggaatgcgtaattcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatattttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcttttatttccacattagatggtaaatccaatagtgaaactatctttttaggaatgtatggactcgcgtttagaggagtgaacgtcttaggcgtcggaaaggatgattcatcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatctggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtttgtgattcgtgttaaaaccatcggagaaggaataaaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggcggtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaagaatttatttctaaatctatgagagatcaacgaaaaggaagagtaggaagagttaatcctgggacatacgtatatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtatctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagagaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgccaattaatgtatgcattagaaccacgcaaggagattgatgtttcagaagttaaaactttatcatcttatatagatttcgaaaatactaaatcagatatcgatgttataaaatctatatcttcgatcttcggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacgtgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcataatagaatgtattgttttaaattggtagctgaatgttataaaaatgccggtattgatacatcgtctaaacgaatattaggtaaagatatttttctgagccaaaacttcacagatgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcactgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatgacgtttttagattaatactttcaatgagataaatatgggtggcagagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtaccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatttcacaactttactgtttttaaactgttcaaaatatagcatcgatccatgagaaatacgtttagccgcctttaatagaggaaatcccaccgcctttctggatctcaccaacgacgatagttctgaccagcaacttatttcttcatcatccacctgttttaacatataataggcaggagatagatatccgtcattgcaatattccttttcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttctatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgagaatatcacaggggcaatgtttaccacaatgtataatataagaaacaatttgggtctaggagatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcattgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaatcagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctaccgtcctaatataccattaaaaattgttagatttttccgcaataacatggtaactggagtagagatagccgatagatctgttatttcagtcgctgattaatcaattagtagagatgagataagaacattataataatcaataatatattttatatcttatatcttgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattattttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaattatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacacttccagtatcaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgtcaactctcaaaatgctgatttcgacggagatgaagaatggatgatattggagcaaaatcctaaagccgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagtcttaccttactatcttccagactctaaggatccagaaggaagaggttacattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataggtatgtagtagatataatagtcaatagattatacatcaagagagcagaaattaccgaattagtcgtcgaatatatgattgaacgattcatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggcaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttactcttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcattgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcgatttctatttttagatgtgatggaaaaatgactaattttgtagcattagtatcatgaactctaatcgagatcttaatatcttcgtcacacgttagttctttgaagtttttaagagatgcatcagttggttcgaccgatggagtaggtgcaacaattttttgttcgatgtatgtatgtactggagccattgtcttaactataatggtgcttgtatcgaaaaactttaatgcagataatggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatttcatataagaaactataaagtccgcactactgttaagaatgattactaacgcaactatatagtttaaattaagcatcttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtatgatgactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgagataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaaacacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacaatatggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttattacacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcgcctataaaaacctttatgttgcctaaacaagatatagtaggtttggatctggaaaatctatatgccgtaactaagactgacggaattcctataactatcagagttacatcaaaagggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgcggacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagatcaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctgaagatatgcacactgataaatttgtcatttatgatatttatacgtttgattcgttcaagaataaacgattggtatttgtacaggtgcctccatcattaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattctgtcaataagacatcaactacctaaggaatattcaagcgaattactctgtccgaggaaacgaaagactgtagaagctaacatacgagacatgttaatagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagttgtacgaaaaaactttatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtctttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacaaaaaatatcatgttcctattatgaaactatatcctacaccggaagagattccggactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatattaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgaggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagactaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggagccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgttgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggtggatctaatggaatccaattgattaactatcttttgaaaatatacatttttatgatccgatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatacgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcattccaagcgatattatctcaacaaaattcagattctatctttagagtatccactaaactattacggtttatgtactacaatgaactaagagaaatctttagacggttgagaaaaggttctatcaacgatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgtccaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctttaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattaacgataggtgtagccgataaacaaatcatcttatggttttttaatgcgatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccaacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgtgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctaaagacaagttaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattggccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaatacccaacttcaccacccttgaatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaatacagactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcttcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgattatttcctgcacgtttaggtttggtacgttgatttctagcccctgcggatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatattcaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggcgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagccggtgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccatataccaaactttcagaagaaatggtgtacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatacaatatcttcggtatcttgacgcaatctagtatacatagagttaagagaaattagagtttgtacattaagcaacatgtctctaaatgtggctgcaaacttttccttttccacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttctcaacgtcgatttgatgaacacacgatgaaaatgtacttcgatgagattgatcatgtagaaaacaacaagggatacaatatttccacatatcatgaaatatattaagaaatcccaccttattatatttccccaaaggatccatgcatgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcatacgatccaaattccggaatagatgtatcgcacgctctggccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcatcaacgagttaaaaaagaccagttcattcaagataagcaaacgcgataaggatacgctactaaaatattttacttaggactggagttagaatttatagacgactcatttcgtttatcattattagtattcttcttgttatcttgttcagaaatatacagcaatgctatgcctaatactaaatacattatcatgcttgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccattttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatttccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttactcttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcctgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgccacggttacattcactgcagcattttgaggatcgcgagtatgaagtacgatgttattgtttactggtatatctggaaagaattctaccagtctaggaataagagattgatatcgcatagaaatacaaaagttcataatctcatcatctaagagcattttgttaccattgtaataaatatccactctgtcatatgtataaatgaagtactgttcaaacatgatgagatgtttatatgttggcatagtagtgagatctacgtttggtaatggcaatgtattaagattaactccataatgtctagcagcatctgcgatgttataagcgttgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattctccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgatatcttctatgccaacacaaacaccatccttgggagtagtttatgataaagataaaagaattcagatgttggaggatgaagtggttaatcttagaaatcaacgatctaatacaaaatcatctgataatttagataattttaccagaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaatattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtaggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggatttggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataatttagttcatggaaatatcgctatgattggtatgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatatccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacccgatgaatcggacaatgtactgggccatgtagaataaattatcaacgaattatcgtctacgaacatttatatcatttgttttaattttagtacgcgaataaatagatataaaatagaaaataacagatattacaaccaatgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacggctgcccccatttttaataatcgtcagtatttaaactgttaaatgttggtatatcaacatttaccttatttcccgcagtataaggtttgttgcaggtatactgttcaggaatggttacatttatactttttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtatttgaaacattaacaacgaccgataataaaattactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcagtagatagtttttttgagccatattccacagataatattagacatatgataaaacgattagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattcttctacaaacgattattagattttttcggatcagaggttgtatttataggagacgcccaaaatagacgtactccagatatggtcaaatcaatcaaggaactaaatagatttatattcgtatccaccttattttattccggtactggtttagatattcctagtttggattctttgttcatttgctcggcagtaatcaacaatatgcaaatagagcaattactagggagggtatgtcgagaaacagaactattagataggacggtatatgtatttcctagcacatccatcaaagaaataaagtacatgataggaaatttcgttcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatctttattattattgacctcgtttatcttggaacatggaatgggaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgaaattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgagactatatatggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcacatagctaaagatttgtcacaatatgaatacactacagttcttctagaacgtcagcctagaaggtcgccgtacgtcaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattatggggaaataaagaaaactgtacatggaggcactaatgcaaattacttttccggtaaaaagtctgatgagtatctgagcactacagtcaggtccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaaacactaattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcctggacttaatcatgcattttctagtctattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccgttggaaaactttaataacaaagaaagagataggtctaacgcctattcaaaattagaaagtaatggattagttagactgaatgctttcttggaatccggagacgctatagcacgaaatatctcatcaagaactcttgaagatgattttgctagagataatcagattagctttgatgtttccgaaaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatatcgcggatgaaacggaacttccatacgatgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaaaccgtcttttctggtgtaatattctagtttggtagtagatacatatcaatatcatcaaattcgagatccgaattataaaatgggcgtggattgttaactatagaatcggacgtctgatattcgaaaatctgtggagttttaggttttggtggaggtgtaactgctacttgggatactgaagtctgatattcagaaagctgggggatgttctggttcgacatccaccgatggtgtcacatcactaatcggttcggtaacgtctgtggacgatggaggcaccacttctacaggttctggttctttatcctcagtcatcaacggagctacttcaatgcgaggaaatgtataatttggtaatggtttctcatgtggatctgaagaagaggtaagatatctactagaaagataccgatcacgttctagttctcttttgtagaacttaactttttctttctccgcatctagttgatattccaacctcttcacgttcgcatgggttacctccgcagtttttacgagcgatttcacgttcagccttcatgcgtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgatcattaataagatttttatcattgctcgttatttcagaatcgtatatataaggagtaccatcgtgattcttaccagatattatacaaaatactatatataaaatatattgacccacgttagtaatcatgtaaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagccgttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtagctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggaacaatttacaaattgggatcgtctatcgatagactttctctaaataggactattgttacaaaagttaataattataattatgatacattttttgacgatgatgattgatcgctattgcacaattttgtttttttactttctaatatagcgtttagattctttttcatgtgcgaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctggattataaacgggtgtaaacaagaatacatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacagagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttaaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggtcgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactgtatgtaaacaatctatcactgattaattattcgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgatgatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccgcacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatgcatgcaaagctctaaatccaaattcggatctaattaagatagagactccaaacgagttaagttttttaagaagcattagacgcggatattgggtaggagaatccgaaatattaaaccagacaaccccatataattttatagctaaaaatgccacgaagaatggaactaaaaaacggaaatatatttgtagtacaacgaatactcccaaactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttatattttgtagtaagaatagaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcagcatttcctacatatacccggctatgtaccgcgttatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaatatagtctgtgttccataatagtttactttcatgatttcattatcggtgtattttccaaatacatccactagagcagctgtatgaataatcagatttaccccatctagcgcttctcttaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcgggcacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaatgaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctctaaaggatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaacaagtttatgagcttttataaggataacctagaaaatatagtagatgctatcattactctaaaatatataatgaataatccagattttaaaactacgtatgccgaagtactcggttccagaatagcggatatagatattaaacaagtgatacgtgagaatatactacaattgtctaataatatccgcgaacgatatttgtgaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatatcgcatccgtttgtacatgtaatgatttaaaatgtgtagtcatgcttattgataaagatctaaaaattaaagcgggccctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccaaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaattaaaataacactatttagttggtggtcgccatggatggtgttattgtatactgtctaaacgcgttagtaaaacatggcgaggaaataaatcatataaaaaatgatttcatgattaaaccatgttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcaatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactttatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagttacagacactgtctcatacactacagtaagtacatcatctggaattgtcactactaaatcaaccaccgatgatgcggatctttatgatacgtacaatgataatgatacagtaccatcaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaacatactgagtttttaggaaatatttacggaacttctaaaactgctgtgaatacagcggctattaataatcgtatttgtgtgatggatctaaacatcgacggtgttagaagttttaaaaatacttacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggttgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcacatatcgccacaaaaactactatgctctaagcggaatcgggtacgagagtctagacttgtgtttggaaggagtagggattcatcatcacgtacttgaaacagaaaacgctgtatatggaaaagttcaacatgattattctactatcaaagagaaggccaaagaaatgaatgcactcagttcaggacctatcatcgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaaccacctctctggaagacagtgtgaatcatgtactcatgaaacgtttggaatctatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatgagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaatctattaatgttaaacatacatctgtttcagctaagcaactaagaacacgtatactctcatcttttgccaacacagagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacacgtgtcgattcatcaaggtatataaacctggggatgaggctacctcgacatacgtgtgcgctatcaaagtggaaagatgctgttgtgctgtgtttgcagattggccagaatcatggtatcaagaagtattctccagatgaataggtgtcacatataaaattttaattaatgtaactatagagaacaaataataggttgtaatatcatatagacaataactaacaattaattagtaactgttatctctttttaactaactaactatacctattaatacatcgtaattatagttcttaacatctattaatcattgattcgcttctttaattttttataaaccaacattgttaattgaaaagggataacatgttacagaatataaattatatatggattttttttaaaaaggaaatacttgactggagtgtatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttatatagatgccgaagacagttacggttgtacattattacatagatgtatatatcactataagaaatcagaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacaatcactacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaagtgcactagtctcgacgtatacggaagtcgtgtacgtaatatcatagcatctattagatatcgtcagagattaattagtctattatccaagaagctggatcctggagataaatggtcgtgttttcctaacgaaataaaatataacgataacgaactgtccacatatctaaaaatcttataaacactattaaaatataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacgtttacatgtgatcagggatatcattcttcggatccaaatgctgtctgcgaaacagataaatggaaatacgaaaatccatgcaaaaaaatgtgcacagtttctgattacatctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtgaatataaatccgttaaaataatgaataattaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggaccaccgactgtaacattaactgaatacgacgaccatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtctccccgctataaaggcattatcaacttctccttattgattgaaaatgaaaatataaatagtttttatgtatagcagtattaccctatagttttattgcttactactaacatggatacagatacagatgttacaaatgtagaagatatcatgaatgaaatagatagagagaaagaagaaatactaaaaaatgtagaaattgaaaataataaaaacattaacaagaatcatcccaatgaatatattagagaagcactcgttattaatacaagtagtaatagtgattccattgataaagaagttatagaatgtatcagtcacgatgtaggaatatagatcatatctactaatttttataatcaatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaatttgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtagactgtttatacaagattgaaatattctttttttatagagtgtggtagtgttacggatatctaatattaatattagactatctctatcgcgctacacgaccaatatcgattactatggatatcttctatgaaaggagagaatgtattcatttctccagcgtcaatctcgtcagtattgacaatactgtattatggagctaatggatccactgctgaacagctatcaaaatatgtagaaaaggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaacaattgtctcctagcaattagtgccgtatactttaaagcaaaatggttgacgccattcgaaaaggaatttaccagtgattatcccttttacgtatcaccaacggaaatggtagacgtaagtatgatgtctatgtacggcgagctatttaatcacgcatctgtaaaagaatcattcggtaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaatttttttcgttggtagatattgctctccgacaactaattgttaaccattttttttaaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtgtagaaatcatccgttgttatataccggatgagcaaaaaaccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctccctttcccagaaacaaactttttttacccactataaaataaaatgagtatactacctgttatatttctttctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcgggcatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagaaggtgttgtaacttcaataggtagtaatttgactattgcgtgtagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttaatatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatatagatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacaatagacacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataatgaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaaaaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagtggaagatacaactgttacgttcattacgacgacgttagaatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctataacgcgactatctaggtatttgtatctcaccgatagagaacatataaatgtagactctattaaacagttgtgtaaaatatcagatcctaatagatgtggatgtacggctttagaaatgagttcattaaaatatgtgatatcaacggaacatatttatataattatactattgctgttagtataattattgattccacggaagaactaccaacagttactccaattacaacaacatataattatactatcgatgatagcactactgaagaactacaagtgactcctcatatggatctccatcgatgatacatgtattaaaatactttccgaataagtcttttaaatattgtattaattatgaaaaactatgctatgcgagtatgatacgatactagattttatctctagcgagagatgtcgttagaatcatttatcaacgaatatcgataacatgtgtcatttatacgttaaagtctgtccgtcttctctattgtttagactgtttgtagaatgctgtgatataaacaaactagtagacacaaatatttaactcatgatgaagttgagaatgatatgctttagctaatataaaaatatattaatccactatatattctagacttgatttaaaaccgataaactactactacgtactgtataagttaggagcagaccctaattatgtagatgatagaggtaatacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtggagatcattaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttcgactgttactctctcgcggagtcgagagactttgtagaaacaacgaaggattaactccgctaggagcatacagtaagcatagatacgtaaaatctcagattgtgcatctactgatatccagctattcgaattcctctaacgaactcaagtcgaatataaatgatttcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctctatccaaggatgtaattaaatgtttgatcgataacaatgtttccatccaatactactggtcttgctcaaccatagatatagagattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtaagtatacctatcattcaatgcatgttggataagacgacggacaacaactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaagatgtatttgatatactaagcaagtacatggatgatatagatatgatcgataactctactatattacgcggtcgatgtcaataatatacaatttgcaaagcggttattggaatatggagcgagtgtcacgctcgataatcaatacggccatccagaaaagcagttaccaaagagaagctagttgatttattactgagttaccatcccactctagagactatgattgacgcatttaatagagatatacgctatctatatcctgaaccattattcgcctgtatcagatacgccttaatcctagatgatgattttccttctaaagtaagtatgatatcgccggtcgtcataaggaactaaagcgctatagagcagacattaatagaatgaagaatgcctacatatcaggcgtctccatgtttgatatattatttaaacgaagcaaacgccacagattgagatacgcaaagaacaatgagaggatcgactccattaaataatttatcatggagtgataatgtcctgtttccatggcatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgcatcgttcgcgacagtatgtggtacatacctaacgtatttatggacgacggtaagaatgaaggtcacgtttctgtcaacaatgtcgacgcgatcgtgtaacacgactcacaatagaatctgtgaatgctctcccgatcatggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacctttaactatatcgatgtggaaattaacctgtatccagttaacgacacatcgtgtactcggacgaccactaccggtctcagcgaatccatctcaacgtcggaactaactattactatgaatcataaagactgcgatcccgtcttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagcgtcgacatctatatactatatagtaataccaatactcaagactacgaaactgatacaatctcttatcatgtgggtaatgtagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtactcaatcaatagcaatcatgaaacaatatatcgtactggcatgcatgtgcctgccagtcttcagcaatcatcctcatcgtgtacggaagaagaaaacaaacatcatatgggaatcgatgttattatcaaagtcacaaagcaagaccaaacaccgaccgatgataagatttgccaatccgtaacggaaattacagagtccgagtcagatccagatcccgaggtggaatcagtcgaggatgtagatcctcctaccacttattactccatcatcggtggaggtctgagaatgaactttggattcaccaaatgtcctcagattaaatccatctcagaatccgctgatggaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaagttacctctcgcgacttcttctttttctgtctcaatagtgtgatacgattatgacactattcctatttcctttcagggtatcacaaaaatattaaacctctttctgatggtctcatacaaaaatatttttattctctttctctctttgatggtctcataaaaaatatttttattctctttctctctttgatggtctcataaaatatttttattctctttctctctttgatggtctcataaaaaatatttttattctctttctctctttgatggtctcataaaatatttttattctctttctctctttgatggtctcataaaaaatatttttattctctttctctctttgatggtctcataaaaaatattaaacctctttctgatggtgtcactaaaatatttttattctctttctctcttcaatggagtcataaaatatttttattctctttctctcttcgatggtctcacaaaaatattaaacctctttctgatggtgtcactaaaatatttttattctctttctctcttcaatggagtcataaaatatttttattctctttctctctttgatggtctcacaaaaatatttttattctctttctctctttgatggtctcacaaaaatatttttattctctttctctctttgatggtctcacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctctttgatggtctcataaaaaaagttttacaaaaatatttttattctctttctctctttgatggtctcataaaaaatattaaacctctttctgatggtgtcactaaaatatttttattctctttctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcactaaaatattttttattctctttctgatgcatcaactatttcttaaacaataacgtccaacaacatatactcgtcgagcttatcaacatcccctatgcccatctaggttaccagacaattgtatatcataaaataatgtttataatttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctctttctctcttcaatggagtcataaaatatttttattctctttctctcttcgatggtctcacaaaaatattaaacctctttctgatggtgtcactaaaatatttttattctcattctctcttcaatggagtcataaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctctttctctcttcaatggagtcataaaatatttttattctctttctctcttcgatggtctcacaaaaatattaaacctctttctgatggtgtcactaaaatatttttattctctttctctcttcaatggagtcataaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaaagttttacaaaaatatttttattctctttctctctttgatggtctcataaaaaatattaaacctctttctgatggtgtcactaaaatatttttattctcattttctctttctctcttcaatggagtcataaaatatttttattctctttctctctttgatggtctcataaaaaatattaaacctctttctgatggtgtcactaaaatatttttattctcattctctcttcaatggagtcataaaaaagttttatctctttctctcttcgatggtctcacaaaaatattaaacctctttctgatggagtcgtaaaaaagttttatctctttctctcttcgatggtctcacaaaaatattaaacctctttctgatgcatcaactatttcttaaacaataacgtccaacaacatatactcatcccctatgcccatctaggttaccagacaattgtatatcataaaataatgtttataatttacacgttaaaatcatataataaaacgtagatcgtataatattttttggtatataaatgatctagtaaaatccatgtaggggatactgctcacattttttctttggtacaaaatttcacacaagtttttatacagacaaattcttgtccatatattttaaaacattgacttttgtactaagaaaaatatctagactaactatctctttctctttctctcttcgatggtctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggtgtcactaaaatatttttattctctttctctcttcgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggagtcgtaaaaaagttttatctctttctccttcgatggtctcacaaaaatattaaacctctttctgatggagtcgtaaaaaagttttatctctttctccttcgatggtctcacaaaaatattaaacctctttctgatggagtcgtaaaaaagttttatctctttctccttcgatggtctcacaaaaatattaaacctctttctgatggagtcgtaaaaaagttttatctctttctctcttcgatggtctcacaaaaatattaaacctctttctgatggagtcgtaaaaaagttttatctctttctctcttcgatggtctcacaaaaatattaaacctctttctgatggagtcgtaaaaaagttttatctctttctccttcgatggtctcacaaaaatattaaacctctttctgatggtctctataaagcgattgatttttcttaccctctagagtttcctacggtcgttggtcacacatttttttctagacactaaataaata

SEQ ID NO: 92 - DNA, 166722 bp, Vaccinia virus
  source 1..166722: mol_type = other DNA
gaccatcaaagagagaaagagaataaaaatattttatgagaccatcaaagagagaaagagaataaaaatattttttatgagaccatcaaagagagaaagagaataaaaatattttatgagaccatcaaagagagaaagagaataaaaatattttttatgagaccatcaaagagagaaagagaataaaaatatttttgtatgagaccatcagaaagaggtttaatatttttgtgataccctgaaaggaaataggaatagtgtcataatcgtatcacactattgagacagaaaaagaagaagtcgcgagaggtaactttttgttttgcaaaccggaatatagtgtccggtacacttttttaattcgtggtgtgcctgaatcgttcgattaaccctactcatccaatttcagatgaatagagttatcgattcagacacacgctttgagttttgttgaatcgatgagtgaagtatcatcggttgcaccttcagatgccgatccgtcgacatacttgacctcaagttcagatgattccttgcacatgtctccgatacgaacgctaaactctagattcttgacacattttgtatcgacgatcgttgaaccgatgatatcttcgtaactcactttcttatgagagatgttagacccgagtactggatgggtcttgatgtcgctgtctttctcttcttcgctacatctgatgtcgatagacacctcacagtctttccatcagcggattctgagatggatttaatctgaggacatttggtgaatccaaagttcattctcagacctccaccgatgatggagtaataagtggtaggaggatctacatcctcgactgattccacctcgggatctggatctgactcggactctgtaatttccgttacggattggcaaatcttatcatcggtcggtgtttggtcttgctttgtgactttgataataacatcgattcccatatgatgtttgttttcttcttccgtacacgatgaggatgattgctgaagactggcaggcacatgcatgccagtacgatatattgtttcatgattgctattgattgagtactgttctttatgattctacttccttaccgtgcaataaattagaatatattttctacttttacgagaaattaattattgtatttatgggtgaaaaacttactataaaaagcgggtgggtttggaattagtgatcagtttatgtatatcgcaactaccgggcatatggctacattacccacatgataagagattgtatcagtttcgtagtcttgagtattggtattactatatagtatatagatgtcgacgctagagttactgtctccgaatgcggcatgatagtatcattctttgctttcgttaactgtttggaggaagaatctttgttattgcatttaatctcgaaattcagagtgcacacctttctcctgtaaagaaacctgaagtcgctaccttattaagaagacgggatcgcagtctttatgattcatagtaatagttagttccgacgttgagatggattcgctgagaccggtagtggtcgtccgagtacacgatgtgtcgttaactggatacaggttaatttccacatcgatatagttaaaggtatttctgggtacgggttcgcatttatctgcggaagagacggtgtgagaatatgttccgagaccacacggagaacagatgacgtctccggatactccgtatcctattccacattttgtttgggaaacacatgccttgcatccatgatcgggagagcattcacagattctattgtgagtcgtgttacacgatcgcgtcgacattgttgacagaaacgtgaccttcattcttaccgtcgtccataaatacgttaggtatgtaccacatactgtcgcgaacgatgcgtccatctcataatgatttactttttcataattaaagatgtgaaagaaaaccgaacaatatatttttttagtaatgtttatgcgagacatataaaataaactccgtgtttatgatgccggtaaatgtttttatcatcttggacggaatcgattttgtaatatgccatggaaacaggacattatcactccatgataaattatttaatggagtcgatcctctcattgttctttgcgtatctcaatctgtggcgtttgcttcgtttaaataatatatcaaacatggagacgcctgatatgtaggcattcttcattctattaatgtctgctctatagcgctttagttccttatgacgaccggcgatatcatacttactttagaaggaaaatcatcatctaggattaaggcgtatctgatacaggcgaataatggttcaggatatagatagcgtatatctctattaaatgcgtcaatcatagtctctagagtgggatggtaactcagtaataaatcaactagcttctctttggtaactgcttttctggatggccgtattgattatcgagcgtgacactcgctccatattccaataaccgctttgcaaattgtatattattgacatcgaccgcgtaatatagtagagttatcgatcatatctatatcatccatgtacttgcttagtatatcaaatacatcttcataacagtgatacccgcaattattaaatctcgataatatcagaccgtacatacatagacggccattgttagatatgtgatttacagccgcgtgtccatattttccacgataaaccttacgacgtttacatcgacgagattattattaacaaagttgttgtccgtcgtcttatccaacatgcattgaatgataggtatacttaccatatcgccgtaatgtaagtagtttatcagtatggcttgtacgatggattcatcctgttgtctaaatctctttagaatgttatcgatgatgtagtggttatattctctggaatcgtacgaagtaatactacgcattacgtcgacaagagtatgacgtctctcaataagaagattaacgatttccatgtctacattatatggggttactctaaatcgcttgtttagataatacgcctctaatatagggctgacgtcgtatactctacacgtgtccacatcctttattaataatctctatatctatggttgagcaagaccagtagtattggatggaaacattgttatcgatcaaacatttaattacatccttggatagagattctctatgagacgatatatagtaatgaagagagttcttacacatatcactgttgtacatacaggtacgaaatacgtaaccggtgctgtaacattctgatttaagaagccatagcaatacttctggtctcggattaggcgtcgttacgtatatatccaccaatccgagaccattgattgcataattcgtattcttggacggacgtatccgtttatccacaattaggtattttagcagacgtaagtcgaaatcatttatattcgacttgagttcgttagaggaattcgaatagctggatatcagtagatgcacaatctgagattttacgtatctatgcttactgtatgctcctagcggagttaatccttcgttgtttctacaaagtctctcgactccgcgagagagtaacagtcgaacaatcttaatgtctgtatcgcatttattggagacgtaacaatgtagcgcattgtttcctcgtctatctatatgttttgataagttgtgacacgtttcaatttctagttttatttttttgtacgtcacatcttcatccagtagacgacatagaatacatgtgcaatccatagctattctggtgctaattattcctcataagatgataaaaagtgtagtgagagagcatgaaggagatttagtatttagcagtgcggatatgatccaagagggtgagatagtcgttctcgttcagaatctttcgcagcataagtagtatgtcgatatacttatcgttgaagactcttccagagacgatagctgattgagtacaaagtccaatgattgcacgaagttcttcggcggttttcatggagtcatttctgatgaaacatttaatgatctaaatttcagtttatgtttgtaccccgtattcatacttaacaaattggtattacataccattaataatgcaagcataaaaaatcgttagtagatgtttctaaatataggttccgtaagcaaagaatataagaatgaagcggtaatgataaaatcaatcgttatctaaaatgatcatactcatttattttattctattatattaacacatacatttttaacagcaacacattcaatattgtattgttatttttatattatttacacaattaacaatatattattagtttatattactgaattaataatataaaattcccaatcttgtcataaacacacactgagaaacagcataaacacaaaatccatcaaaaatgttgataaattatctgatgttgttgttcgctgctatgataatcagatcattcgccgatagtggtaacgctatcgaaacgacatcgccagaaattacaaacgctacaacagatattccagctatcagattatgcggtccagagggagatggatattgtttacacggtgactgtatccacgctagagatatcgacggtatgtattgtagatgctctcatggttatacaggcattagatgtcagcatgtagtattagtagactatcaacgttcagaaaaaccaaacactacaacgtcatatatcccatctcccggtattatgcttgtattagtaggcattattattattacgtgttgtctattatctgtttataggttcactcgacgaactaaactacctatacaagatatggttgtgccataatttttataaattttttttatgagtatttttacaaaaatgtataaagtgtatgtcttatgtatatttataaaaatgctaaatatgcgatgtatctatgttatttgtatttatctaaacaatacctctacctctagatattatacaaaaattttttatttcggcatattaaagtaaaatctagttaccttgaaaatgaatacagtgggtggttccgtatcaccagtaagaacataatagtcgaatacagtatccgattgagattttgcatacaatactagtctagaaagaaatttgtaatcatcttctgtgacgggagtccatatatctgtatcatcgtcccatgctatattcctgttatcatcattagttaatgaaaataactctcgtgcttcagaaaagtcaaatattgtatccatacatacatctccaaaactatcgcttatacgtttatctttaacgatacctatacctagatggttatttactaacagacattttccagatctattgactataactcctatagtttccacatcaaccaagtaatgatcatctattgttatataacaataacataactcttttccgtttttatcagtatgtatatctatatcaacgtcgtcgttgtagtgaatagtagtcattgatctattatatgaaacggatatgtctagaacggcaattgttttacgtccagttaacactttcgttgatttaaagtctagagtctttgcaaacataatatccttatccgactttatatttcctgtagggtggtataattttattttgcctccacatatcggtgtttccaaatatattactagacaatattccatatagttattagttaagggtacccaattagaacacgtacgcttattatcatcatttggatcgtatttcataaaagttattgtactatcgatgtcaacacattctacattttttaatcgtctatatagtatttttctgatattttctataatatcagaattgtcttccatcggaagttgtatactatcggaatcagttacatgtttaaataattctctgatgtcattccttatacaatcaaattcattattaaacagtttaatagtctgtagacctttatcgtcgtaaatatccattgtcttattagttacgcttatttttatgtgtttttacgttgctttattatattttataagaatgattgtttgacgaatcacgagaactattaagacacattattaggtatatattataaaaaagtttttgattacgatgttataagaggaaagaggacacattaacatcatacatcaattaactacattcttataacatcgtaatcaaaagaattgcaattttgatgtataacaactgtcaatgggttatggaattgtatattacatattatacggtatgttggtaacgacaaataccgatcggtaattgtctgccggtgtaatagaattatatatatctatctattacaccggccttgtatacataataataagttgtggtagtatgatctccatatttataatttaggactttgtattcagtttttttggaatcataaaaaataaaaaaaagttttactaatttaaaattatttacatttttttcactgtttagtcgcggatatggaattcgatcctgccaaaatcaatacatcatctatagatcatgtaacaatattacaatacatagatgaaccaaatgatataagactaacagtatgcattatcacaaaaataaatccacatttggctaatcaatttcgggcttggaaaaaacgtatcgccggaagggactatatgactaacttatctagagatacaggaatacaacaatcaaaacttactgaaactgtcaaaaaaatagaaacatatatggtctatatatacactacaatttagttattaattggataaccgatgtgattatcaatcaatattaagaaggttggtaaattggtacatagctaataatacctatacacccaataatacaacaaccatttctgagttggatatcatcaaaatactggataaatacgaggacgtgtatagagtaagtaaagaaaaagaatgtgaaatttgctatgaagttgtttactcaaaacgatagatactttggtttattggattcgtgtaatcatatattttgcataacatgcatcaatatatggcatagaacacgaagagaaaccggtgcgtcggataattgtcctatatgtcgtacccgttttagaaacataacaatgagcaagttaactaataaataaaaagtttaatttgttgacgacgtatgtcgttattttttctcgtataaaagattaatttgattctaatataatctttagtattggataaatatcaattcaaattaattccattagattatatcataaataaaaatagtagcacgcactacttcagccaaatattcttttttgaaacgccatctatcgtagtgaggacacaagtgaacctataatgagcaaatttattagtatcggttacatgaaggactttacgtagagtggtgattccactatctgtggtacgaacggtttcatcttctttgatgccatcacccagatgttctataaacttggtatcctttgccaaccaatacatatagctaaactcaggcatatgttccacacatcctgaacaatgaaattctccagaagatgttacaatgtctagatttggacatttggtttcaaccgcgttaacatatgagtgaacacacccatacatgaaagcgatgagaaataggattttcatcttgccaaaatatcactagaaaaaatttatttatcaattttaaaggtataaaaaatacttattgttgctcgaatattttgtatttgatggtatacggaagattagaaatgtaggtattatcatcaactgattctatggttttatgtattctatcatgtttcactattgcgttggaaataatatcatatgcttccacatatattttattttgttttaactcataatactcacgtaattctggattattgacatatctatgaataattttagctccatgatcagtaaatattaatgagaacatagtattaccacctaccattatttttttcatctcattcaattcttaattgcaaagatctatataatcattatagcgttgacttatggactctggaatcttagacgatgtacagtcatctataatcatggcatatttaatacattgttttatagcatagtcgttatctacgatgttagatatttctctcaatgaatcaatcacacaatctaatgtaggtttatgacataatagcattttcagcagttcaatgtttttagattcgttgatggcaatggctatacatgtatatccgttatttgatctaatgttgacatctgaaccggattctagcagtaaagatactagagattgtttattatatctaacagccttgtgaagaagtgtttctcctcgtttgtcaatcatgttaatgtctttaagataaggtaggcaaatgtttatagtactaagaattgggcaagcataagacatgtcacaaagaccctttttgtatgtataagtgtaaaaattataacattcatagttggatttacataggtgtccaatcgggatctctccatcatcgagataattgatggcatctcccttccttttttagtagatatttcatcgtgtaagaatcaatattaatatttctaaagtatccgtgtatagcctctttatttaccacagttccatattccactagagggatatcgccgaatgtcatatactcaattagtatatgttggaggacatccgagttcattgttttcaatatcaaaaagatggtttccttatcatttctccatagtggtacaatactacacattattccgtgcggctttccattttccaaaaacaatttgaccaaatctacatctttattgtatctataatcactatttagataatcagccataattactcgagtgcaacatgttagatcgtctatatatgaataagccgtgttatctattcctttcattaacaatttaacgatgtctatatctatatgagatgacttaatataatattgaagagctgtacaatagtttttatctataaaagacggcttgattccgtgattaattagacatttaacaacttccggacgcacatatgctctcgtatccgactctgaatacagatgagagatgatatacagatgcaatacggtaccgcaatttcgtagttgataatcatcatacgcgtatcagtactcgtcctcataaagaacactgcagccattttctatgaacaaatcaataatttcaggaacaggatcatctgtcattacataattttctataactgaacgatggttttcacatttaacactcaagtcaaatccatgttctaccaacacctttatcaagtcaacgtctacatttttggatttcatatagctgaatatattaaagtcatttatgttgctaaatccagtggcttctagtagagccatcgctatatcctttaactttaacatgtctactatttgtgtattcttctaatggggtagctgtctccaatttttgcgtaatggattagtgccactgtctagtagtagtttgacgacctcgacattattacaatgctcattaaaaaggtatgcgtgtaaagcattattcttgaattggttcctggtatcattaggatctctgtctctcaacatctgtttaagttcatcgagagccacctcctcattttccaaatagtcaaacattttgactgaatgagctactgtgaactctatacacccacacaactaatgtcattaaatatcatgtcaaaaacttgtacaattattaataaaaataatttagtgtttaaattttaccagttccagattttacacctccgttaaccccactttttacaccactggacgatcctcctccccacattccaccgccaccagatgtataagttttagatcctttattactaccatcatgtccatggataaagacactccacatgccgccactaccccctttagaagacatattaataagacttaaggacaagtttaacaataaaattaatcacgagtaccctactaccaacctacactattatatgattatagtttctatttttacagtaccttaactaaagtctctagtcacaagagcaatactaccaacctacactattatatgattatagtttctatttttataggaacgcgtacgagaaaatcaaatgtctaatttctaacggtagtgttgataaacgattatcgtcaatggatacctcctctatcatgtcgtctattttcttactttgttctattaacttattagcattatatattatttgattataaaacttatattgcttattagcccaatctgtaaatatcggattattaacatatcgtttctttgtaggtttatttaacatgtacatcactgtaagcatgtccgtaccatttattttaatttgacgcatatccgcaatttctttttcgcagtcggttataaattctatatatgatggatacatgctacatgtgtacttataatcgactaatatgaagtacttgatacatattttcagtaacgatttattattaccacctatgaataagtacctgtgatcgtctaggtaatcaactgttttcttaatacattcgatggttggtaatttactcagaataatttccaatatcttaatatataattctgctatttctgggatatatttatctgccagtataacacaaatagtaatacatgtaaacccatattttgttattatattaatgtctgcgccattatctattaaccattctactaggctgacactatgcgacttaatacaatgataaagtatactacatccatgtttatatcatcaatatacggcttacaaagttttagtatcgataacacatccaactcacgcatagagaaggtagggaataatggcataatatttattaggttatcatcattgtcattatctacaactaagtttccattttttaaaatatactcgacaactttaggatctctattgccaaatttttgaaaatatttatttatatgcttaaatctatataatgtagctccttcatcaatcatacatttaataacattgatgtatactgtatgataagatacatattctaacaatagatcttgtatagaatctgtatatcttttaagaattgtggatattattacgtaaactattacacaattctaaaatataaaacgtatcacggtcgaataatagttgatcaactatataattatcgattttgtgatttttcttcctaaactgtttacgtaaatagttagatagaatattcattagttcatgaccactatagttactatcgaataacgcgtcaaatatttcccgtttaatatcgcatttgtcaagataataatagagtgtggtatgttcacgataagtataataacgcatctctttttcgtgtgaaattaaatagtttattacgtccaaagatgtagcataaccatcttgtgacctagtaataatataataatagagaactgttttacccattctatcatcataatcagtggtgtagtcgtaatcgtaattgtctaattcatcatcccaattataatattcaccagcacgtctaatctgttctattttgatcttgtatccatactgtatgttgctacatgtaggtattcctttatccaataatagtttaaacacatctacattgggatttgatgttgtagcgtatttttctacaatattaataccatttttgatactatttatttctatacctttcgaaattagtaatttcaataagtctatatcgatgttatcagaacatagatattcgagtatatcaaaatcattgatatttttatagtcgactgacgacaataacaaaatcacaacatcgtttttgatattattatttttcttggtaacgtatgcctttaatggagtttcaccatcatactcatataatggatttgcaccactttctatcaatgattgtgcactgctggcatcgatgttaaatgttttacaactatcatagagtatcttatcgttaaccatgattggttgttgatgctatcgcattttttggtttctttcatttcagttatgtatggatttagcacgtttgggaagcatgagctcatatgatttcagtactgtagtgtcagtactattagtttcaataagatcaatctctagatctatagaatcaaaacacgataggtcagaagataatgaatatctgtaggcttcttgttgtactgtaacttctcgttttgttagatgtttgcatcgtgctttaacatcaatggtacaaattttatcctcgctttgtgtatcatattcgtccctactataaaattgtatattcagattatcatgagatgtgtatacgctaacggtatcaataaacggagcacaccatttagtcataaccgtaatccaaaaatttttaaagtatatcttaacgaaagaagttgtgtcattgtctacggtgtatggtactagatcctcataagtgtatatatctagagtaatgtttaatttatcaaatggttgataatatggatcctcatgacaatttccgaagatggaaatgagatatagacatgcaataaatctaattgcggacatggttactccttaaaaaaatacgaataatcaccttggctatttagtaagtgtcatttaacactatactcatattaatccatggactcataatctctatacgggattaacggatgttctatatacggggatgagtagttttcttctttaactttatactttttactaatcatatttagactgatgtatgggtaatagtgtttaaagagttcgttctcatcatcagaataaatcaatatctctgtttttttgttatacagatgtattacagcctcatatattacgtaatagaacgtgtcatctaccttattaactttcaccgcatagttgtttgcaaatacggttaatcctttgacctcgtcgatttccgaccaatctgggcgtataatgaatctaaactttaatttcttgtaatcattcgaaataatttttagtttgcatccgtagttatcccctttatgtaactgtaaatttctcaacgcgatatctccattaataatgatgtcgaattcgtgctgtatacccatactgaatggatgaacgaataccgacggcgttaatagtaatttactttttcatctttacatattgggtactagttttactatcataagtttataaattccacaagctactatggaataagccaaccatcttagtataacacacatgtcttaaagtttattaattaattacatgttgttttatatatcgctacgaatttaaacagagaaatcagtttaggaaaaaaaaatatctatctacatcatcacgtctctgtattctacgatagagtgctactttaagatgagacatatccgtgtcatcaaaaatatactccattaaaatgattattccggcagcgaacttgatattggatatatcacaacctttgttaatatctacgacaatagacagcagtcccatggttccataaacagtgagtttatctttctttgaagagatattttgtagagatcttataaaactgtcgaatgacatcgcatttatatctttagctaaatcgtatatgttaccatcgtaatatctaaccgcgtctatcttaaacgtttccatcgctttaaagacgtttccgatagatggtctcatttcatcagtcatactgagccaacaaatataatcgtgtataacatctttgatagaatcagactctaaagaaaacgaatcggctttattatacgcattcatgataaacttaatgaaaaatgtttttcgttgtttaagttggatgaatagtatgtcttaataattgttattatttcattaattaatatttagtaacgagtacactctataaaaacgagaatgacataactagttatcaaagtgtctaggacgcgtaattttcatatggtatagatcctgtaagcattgtctgtattctggagctattttctctatatctaatttctgaacgttcaccaatgtctctagccactttggcactaatagcgatcattcgcttagcgtcttctatattattaactggttgattcaatctatctagcaatggaccgtcggacagcgtcattctcatgttcttaatcaatgtacatacatcgccgtcatctaccaattcatccaacaacataagctttttaaaatcatcattataataggtttgatcgttgtcatttctccaaagaatatatctaataagtagagtcctcatgattagttaacaactattttttatgttaaatcaattagtacaccgctatgtttaatacttattcatattttagtttttaggattgagaatcaatacaaaaattaatgcatcattaattttagaaatacttagtttccacgtagtcaatgaaacatttgaactcatcgtacaggacgttctcgtacaggacgtaactataaaccggtttatatttgttcaagatagatacaaatccgataactttttttacgaattctacgggatccactttaaaagtgtcataccgggttctttttatttttttaaacagattaatggtgtgatgttgattaggtcttttacgaatttgatatagaatagcgtttacatattctccataatggtcaatcgccatttgttcgtatgtcataaattctttaattatatgacactgtgtattatttagttcatccttgttcatcattaggaatctatccaatatggcaattatactagaactataggtgcgttgtatacacatattgatgtgtctgtttatacaatccatgctactaccttcgggtaaaattgtagcatcatataccatttctagtactttaggttcattgttatccattgcagaggacgtcatgatcgcatcctaaaaaaatatattatttttatgttattttgttaaaaataatcatcgaatacgaatcatccagtccactgaatagcaaaatctttactattttggtatcttccaatgtggctgcctgatgtaatggaaattcattctctagaagatttttcaatgctccagcgttcaacaacgtacatactagacgcacgttattatcagctattgcataatacaaggcactatgtccatggacatccgccttaaatgcatctttgctagagagaaagcttttcagctgcttagacttccaagtattaattcgtgacagatccatgtctgaaacgagacgctaattagtgtataatttttgtcatattgcaccagaattaataatatctctaatagatctgattagtagatacatggctatcgcaaaacaacatatacacatttaataaaaataatatttattaagaaaattcagatttcacgtacccatcaatataaataaaataatgattccttacaccgtacccatattaaggagattctaccttacccataaacaatataaatccagtaatatcatgtctgatgatgaacacaaatggtgtattaaattccagtttttcaggagatgatctcgccgtagctaccataatagtagatgcctctgctacagttccttgttcgtcgacatctatctttgcattctgaaacattttataaatatataatgggtccctagtcatatgtttaaacgacgcattatctggattaaacatactaggagccatcatttcggctatcgacttaatatccctcttattttcgatagaaaatttagggagtttaagattgtacactttattccctaattgaaacgaccaatagtctaattttgcagccgtaatagaatctgtgaaatgggtcatattatcacctattgccaggtacatactaatattagcatccttatacggaaggcgtaccatgtcatattctttgtcatcgattgtgattgtatttccttgcaatttagtaactacgttcatcatgggaaccgttttcgtaccgtacttattagtaaaactagcattgcgtgttttagtgatatcaaacggatattgccatatacctttaaaatatatagtattaatgattgcccatagagtattattgtcgagcatattagaatctactacattagacataccggatctacgttctactatagaattaattttattaaccgcatctcgtctaaagtttaatctatataggccgaatctatgatattgttgataatacgacggtttaatacacacagtattatctacgaaactttgataagttagatcagtgtacgtatatttagatgttttcagcttagctaatcctgatattaattctgtaaatgctggacccagatctctttttctcaaatccatagtcttcaataattctattctagtattacctgatgcaggcaatagcgacataaacatagaaaacgaataaccaaacggtgagaagacaatattatcatcttgaatatttttatacgctactataccggcattggtaaatccttgtagacgataggtagacgctgaacacgttaacgatagtatcaataacgcaatcatgattttatggtattaataattaaccttatttttatgttcggtataaaaattattgatgtctacacatccttttgtaattgacatctatatatccttttgtataatcaactctaatcactttaacttttacagttttccctaccagtttatccctatattcaacatatctatccatatgcatcttaacactctctgccaagatagcttcagagtgaggatagtcaaaaagataaatatatagagcataatcattctcgtatactctgccctttattacatcgcccgcattgggcaacgaataacaaaatgcaagcatcttgttaacgggctcgtaaattgggataaaaattatgtttttatatctattttattcaagagaatattcaggaatttctttttccggttgtatctcatcgcagtatatatcatttgtacattgtttcatattttttaatagtttacaccttttagtaggactagtatcgtacaattcatagctgtattttgaattccaatcacgcataaaaatatcttctaattgttgacgaagacctaatccatcatccggtgtaatattaatagatgctccacatgtatccgtaaagtaatttcctgtccaatttgaggtacctatataggccgttttatcggttaccatatatttggcatggtttaccctagaatacggaatgggaggatcagcatctggtacaataaatagctttacttctatatttatgtttttagattttagcatagcgatagatcttaaaaagtttctcatgataaacgaagatcgttgccagcaactaatcaatagcttaacggatacttgtctgtctatagcggatcttcttaattcatcttctatataaggccaaaacaaaattttacccgccttcgaataaataatagggataaagttcataacagatacataaacgaatttactcgcatttctaatacatgacaataaagcggttaaatcattggttctttccatagtacatagttgttgcggtgcagaagcaataaatacagagtgtggaacaccacttacgttaatactaagaggatgatctgtattataatacgacggataaaagtttttccaattatatggtagattgttaactccaagataccagtatacctcaaaaatttgagtgagatccgctgccaagttcctattattgaagatcgcaatacccaattctttgacctgagttagtgatctccaatccatgttagcgcttcctaaataaatatgtgtattatcagatatccaaaattttgtatgaagaactcctcctaggatatttgtaatatctatgtatcgtacttcaactccggccatttgtagtctttcaacatcctttaatggtttgttagatttattgacggctactctaactcgtactcctcttttgggtaattgtacaatctcgtttaatattatcgtgccgaaattcgtacccacttcatccgataaactccaataaaaagatgatatatctagtgtttttgtggtattggatagaatttccctccacatgttaaatgtagacaaatatactttatcaaattgcatacctataggaatagtctctgtaatcactgcgattgtattatccggattcattttatttgttaaaagaataatcctatatcacttcactctattaaaaatccaagtttctatttctttcatgactgattttttaacttcatccgtttccttatgaagatgatgtttggcaccttcataaatttttatttctctattacaatttgcatgttgcatgaaataatatgcacctaaaacatcgctaatctcattgtttgttccctggagtatgagagtcggggtgttaatcttggaaattatttttctaaccttgttggtagccttcaagacctgactagcaaatccagccttaattttttcatgattgattaatgggtcgtattggtatttataaactttatccatatctctagatactgattctggacatagctttccgactggcgcatttggtgtgatggttcccataagtttggcagctagcagattcagtcttgaaacagcatctgcattaactagaggagacattagaatcattgctgtaaacaagtttggattatcgtaagaggctagtatagaaattgttgctcccatggaatgacccaataagtagatttaatagttaccacgtgctgtaccaaagtcatcaatcatcattttttcaccattacttcttccatgtccaatatgatcatgtgagaatactaaaattcctaacgatgatatgttttcagctagttcgtcataacgtccagaatgtttaccagctccatgacttatgaatactaatgccttaggatatgtaatcattgtccagattgaacatacagtttgcactcatgattcacgttatataactatcaatattaacagttcgtttgatgatcatattatttttatgttttattgataattgtaaaaacatacaattaaatcaatatagaggaaggagacggctactgtcttttgtgagatagtcatggcgactaaattagattatgaggatgctgttttttactttgtggatgatgataaaatatgtagtcgcgactccatcatcgatctaatagatgaatatattacgtggagaaatcatgttatagtgtttaacaaagatattaccagttgtggaagactgtacaaggaattgatgaagttcgatgatgtcgctatacggtactatggtattgataaaattaatgagattgtcgaagctatgagcgaaggagaccactacatcaattttacaaaagtccatgatcaggaaagtttattcgctaccataggaatatgtgctaaaatcactgaacattggggatacaaaaagatttcagaatctagattccaatcattgggaaacattacagatctgatgaccgacgataatataaacatcttgatactttttctagaaaaaaaattgaattgatgatataggggtcttcataacgcataattattacgttagcattctatatccgtgttaaaaaaaattatcctatcatgtatttgagagttttatatgtagcaaacatgatagctgtgatgccaataagctttagatattcacgcgtgctagtgttagggatggtattatctggtggtgaaatgtccgttatataatctacaaaacaatcatcgcatatagtatgcgatagtagagtaaacatttttatagtttttactggattcatacatcgtctacccaattcggttatgaatgaaattgtcgccaatcttacacccaaccccttgttatccattagtatagtattaacttcgttatttatgtcataaactgtaaatgattttgtagatgccatatcatacatgatattcatgtccctattataatcattactaactttatcacaatatatgttgataatatctatatatgatctagtctttgtgggcaactgtctatacaagtcgtctaaacgttgtttactcatatagtatcgaacagccatcattacatggtcccgttccgttgatagataatcgagtatgttagtggacttgtcaaatctatataccatattttctggaagtggatatacatagtcgtgatcaacattattgctagcctcatcttctatatcctgtactataccatctacataatctacgatattattacacataaacatcgacaacatactattgtttattatctaagtcctgttgatccaaacccttgatctcctctatttgtactatctagagattgtacttcttccagttctggataatatatacgttgatagattagctgagctattctatctccagtatttacattaaacgtacattttccattattaataagaatgactcctatgtttcccctataatcttcgtctattacaccacctcctatatcaatgccttttagtgacagaccagacctaggagctattctaccatagcaaatcttaggcatggacatactaatatctgtcttaattaactgtctttctcctggagggatagtataatcgtaagcgctatacaaatcatatccggcagcacccggcgattgcctagtaggagatttagctctgttagtttccttaacaaatctaactggtgagttaatattcatgttgaacataaaactaatattttatttcaaaattatttaccatcccatatattccatgaataagtgtgatgattgtacacttctatagtatctatatacgattcacgataaaatcctcctatcaatagcagtttattatccactatgatcaattctggattatccctcggataaataggatcatctatcagagtccatgtattgctggattcacaataaaattccgcatttctaccaaccaagaataaccttctaccgaacactaacgcgcatgatttataatgaggataataagtggatggtccaaactgccactgatcatgattgggtagcaaatattctgtagttgtatcagtttcagaatgtcctcccattacgtatataacattgtttatggatgccactgctggattacatctaggtttcagaagactcggcatattaacccaagcagcatccccgtggaaccaacgctcaacagatgtgggatttggtagacctcctactacgtataatttattgttagcgggtatcccgctagcatacagtctggggctattcatcggaggaattggaatccaattgtttgatatataatttacagctatagcattgttatgtatttcattgttcatccatccaccgatgagatatactacttctccaacatgagtacttgtacacatatggaatatatctataatttgatccatgttcataggatactctatgaatggatacttgtatgatttgcgtggttgtttatcacaatgaaatattttggtacagtctagtatccattttacattatttatacctctgggagaaagataatttgacctgattacatttttgataaggagtagcagatttcctaatttatttcttcgctttatataccacttaatgacaaaatcctcatctggaacatttagttcatcgctttctagaataagtttcatagatagataatcaaaattgtctatgatgtcatcttccagttccaaaaagtgtttggcaataaagtttttagtatgacataagagattggatagtccgtattctatacccatcatgtaacactcgacacaatattcctttctaaaatctcgtaggataaagtttatacaagtgtagatgataaattctacagaggttaatatagaagcacgtaataaattgacgacgttatgactatctatatatacctttccagtatatgagtaaataactatagaagttagactgtgaatgtcaaggtctagacaaaccctcgtaactggatctttatttttcgtgtatttttgacgtaaatgtgtgcgaaagtaaggagataactttttcaatatcgtagaattgactattatattgcctcctatggcatcaataattgttttgaatttcttagtcatagacaatgctaatatattcttacagtacacagtattgacaaatatcggcatttatgtttctttaaaagtcaacatctaaagaaaaatgattatcttcttgagacataactcccattttttggtattcacccacacgtttttcgaaaaaattagttttaccttctaatgatatattttccatgaaatcaaacggattggtaacattataaatttttttaaatcccaattcagaaatcaatctatccgcgacgaattctatatatgttttcatcatttcacaattcattcctataagtttaactggaagagccgcagtaagaaattcttgttcaatggataccgcatctgttataatagatctaacggtttcttcactcggtggatgcaataaatgtttaaacatcaaacatgcgaagtcgcagtgtagaccctcgtctctactaatcaattcgttggaaaacgtgagtccgggcattaggccacgctttttaagccaaaatatggaagcgaatgatccggaaaagaagattccttctactgcagcaaaggcaataagtctctctccataaccggcgctgtcatgtatccacttttgagcccaatcggccttcttttttacacaaggcatcgtttctatggcattaaagagatagtttttttcattactatctttaacataagtatcgatcaaaagactatacatttccgaatgaatgttttcaatggccatctgaaatccgtagaaacatctagcctcggtaatctgtacttctgtacaaaatcgttccgccaaattttcattcactattccgtcactggctgcaaaaaacgccaatacatgttttataaaatatttttcgtctggtgttagtttattccaatcattgatatctttagatatatctacttcttccactgtccaaaatgatgcctctgcctttttatacatgttccagatgtcatgatattggattgggaaaataacaaatctatttggatttggtgcaaggatgggttccataactaaattaacaataacaataaattttttttcagttatctatatgcctgtacttggatcttttgtacatcgatatcgccgcaatcactacaataattacaagtattattgatagcattgttattagtactatcataattaaattatcgttattatcattttgtaattgtgacatcatactagataaatcgtttgcgagattgttgtgggaagcgggcatggaggatgaattatcgttattattatttaaagcctcccattcggattcacaaatatggcgcgcgttcaacattttatggaaacagataacaagaaaactcgtcatcgttcaaatttttaacgatagtaaaccgattaaacgtcgagctaatttctaacgctagcgactctgttggatatgggtttccagatatatatcttttcagttcccctacgtatctataatcatctgtaggaaatggaagatatttccatttatctactgttcctaatatcatatgtggtggtgtagtagaaccattaagcgcgaaagatgttatttcgcatcgtattttaacttcgcaataatttctggttagataacgcactctaccagtcaagtcaatgatattagcctttacagatatattcatagtagtcgtaacgatgactccatcttttagatgcgatactcctttgtatgtaccagaatcttcgtacctcaaactcgatatatttaaacaagttaatgagatattaacgcgttttatgaatgatgatatataaccagaagttttatcctcggtggctagcgctataaccttatcattataataccaactagtgtgattaatatgtgacacgttagtgtgggtacaaatatgtacattatcgtctacgtcgtattcgatacatccgcatacagccaacaaatataaaatgacaaatactctaacgccgttcgtacccatcttgatgcggtttaataaatgttttgatttcaatttattgtaaaaaaagattcggttttatactgttcgatattctcattgcttatattttcatctatcatctccacacagtcaaatccgtggttagcatgcacctcatcaaccggtaaaagactatcggactcttctatcattataactctagaatatttaatttggtcattattaatcaagtcaattatcttatttttaacaaacgtgagtattttactcattttttataaaaacttttagaaatatacagactctatcgtgtgtctatatcttctttttatatccaatgtatttatgtctgatttttcttcatttatcatatataatggtccaaattctacacgtgcttcggattcatccagatcattaaggttcttataattgtaacatccttctcttccctcttctacatcttccttcttattcttattcttagcgtcacagaatctaccacagcaggatcccatgacgagcgtcatattaaactaatccattttcaattataatatacgattagtaatgaccattaaaataaaaatattcttcataaccggcaagaaagtgaaaagttcacattgaaactatgtcagtagtatacatcatgaaatgatgatatatatatactctattttggtggaggattatatgatataattcgtggataatcattcttaagacacatttcttcattcgtaaatcttttcacgttaaatgagtgtccatattttgcaatttcttcatatgatggcggtgtacgtggacgaggctgctcctgttcttgttgtagtcgccgactgtcgtgtctgcgtttagatccctccattatcgcgattgcgtagatggagtactattttataccttgtaattaaatttttttattaattaaacgtataaaaacgttccgtatctgtatttaagagccagatttcgtctaatagaacaaatagctacagtaaaaataactagaataattgctacacccactagaaaccacggatcgtaatacggcaatcggttttcgataataggtggaacgtatattttatttaaggacttaacaattgtctgtaaaccacaatttgcttccgcggatcctgtattaactatctgtaaaagcatatgttgaccgggcggagccgaacattctccgatatccaatttctgtatatctataatattattaacctccgcatacgcattacagttcttttctagcttggataccgcactaggtacatcgtctagatctattcctatttcctcagcgatagctcttctatccttttccggaagcaatgaaatcacttcaataaatgattcaaccatgagtgtgaaactaagtcgagaattactcatgcatttgttagttattcggagcgcgcaatttttaaactgtcctataacctctcctatatgaatagcacaagtgacattagtagggatagaatgttgagctaatttttgtaaataactatctataaaaagattatacaaagttttaaactctttagtttccgccatttatccagtctgagaaaatgtctctcataataaatttttccaagaaactaattgggtgaagaatggaaacctttaatctatatttatcacagtctgttttggtacacatgatgaattcttccaatgccgtactaaattcgatatctttttcgatttctggatatgtttttaataaagtatgaacaaagaaatggaaatcgtaataccagttatgtttaactttgaaattgttttttattttcttgttaatgattccagccacttgggaaaagtcaaagtcgtttaatgccgatttaatacgttcattaaaaacaaactttttatcctttagatgaattattattggttcattggaatcaaaaagtaagatattatcgggtttaagatctgcgtgtaaaaagttgtcgcagcatggtagttcgtaaattttaatgtataacagagccatctgtaaaaagataaactttatgtattgtaccaaagatttaaatcctaatttgatagctagctcggtatctactttatctgccgaatacagtgctaggggaaaaattataatatttcctctttcgtattcgtagttagttctcttttcatgttcgaaaaagtgaaacatgcggttaaaatagtttataacattaatattactgttaataactgccggataaaagtgggatagtaatttcacgaatttgatactgtcctttctctcgttaaacgcctttaaaaaaactttagaagaatatctcaatgatagttcctgaccatccatagtttgtatcaataatagcaacatatgaagaacacgtttatacagagtatgtaaaaatgttaatttatagtttaatcccatggcccacgcacacacgattaattttttttcatctccctttagattgttgtatagaaatttgggtactgtgaactccgccgtagtttccatgggactatataattttgtggcctcgaatacaaattttactacatagttatctatcttaaagactataccatatcctcctgtagatatgtgataaaaatcgtcgtttataggataaaatcgtttatccttttgttggaaaaaggatgaattaatgtaatcattctcttctatctttagtagtgtttccttattaaaattcttaaaataatttaacaatctaactgatggagcccaattttggtgtaaatctaattgggacattatattgttaaaatacaaacagtctcctaatataacagtatctgataatctatggggagacatccattgatattcaggggatgaatcattggcaacacccatttattgtacaaaaagccccaatttacaaacgaaagtccaggtttgatagagacaaactattaactattttgtctctgtttttaatttctttggtaatgaaattattcacaatatcagtatcttctttatctaccagagattttactaacttgataaccttggctgtctcattcaatagggtagtaatatttgtatgtgtgatattgatatcttttagaagtgattctttgatggtgccagcatacgaattacaataatgcagaaactcggttaacatgcaggaattatagtaagccaattccaattgttgcctgtgttgtattagagtgtcaatatgagcaatggtgtccttgcgtttctctgatagaatgcgagcagcgattttggcgttatcatttgacgatatttctggaatgacgaatcctgtttctactaactttttggtaggacaaagtgaaacaatcaagaagatagcttctcctcctatttgtggaagaaattgaactcctctagatgatctccttgacagatattggaccgaattacagaagtacctggaatgtaaagccctgaaaccccctcattttttaagcagattgttgccgtaaatcctgcactatgcccaagatagagagctcctttggtgaatccatctctatgtttcagtttaaccaagaaacagtcagctggtctaaaatttccatctctatctaatacagcatctaacttgatgtcaggaactatgaccggttatgttatatgtaacattgagtaaatccttaagttcataatcatcactgtcatcagttatgtacgatccaaacaatgtttctactggcatagtggatacgaagatgctatccatcagaatgtttccctgattagtattttctatatagctattcttctttaaacgattttccaaatcagtaactatgttcatttttttaggagtaggacgcctagccagtatggaagaggattttctagatcctctcttcaacatctttgatctcaatggaatgcaaaaccccatagtgtaacaaccaacgataaaaataatattgtttttcactttttataattttaccatctgactcatggattcattaatatctttataagagctactaacgtataattctttataactgaactgagatatatacaccggatctatggtttccataattgagtaaatgaatgctcggcaataactaatggcaaatgtataaaacaacgaaattatactagagttgttaaagttaatattttctatgagctgttccaataaattatttgttgtaactgcgttcaagtcataaatcatcttgatactatccagtaaaccgtttttaagttctggaatattattatcccattgtaaagcccctaattcgactatcgaatatcctgctctgatagcagtttcaatatcgacggacgtcaatactgtaataaaggtggtagtattgtcatcatcgtgataaactactggaatatggtcgttagtaggtacggtaactttacacaacgcgatatataactttccttttgtaccatttttaacgtagttgggacgtcctgcagggtattgttttgaagaaatgatatcgagaacagatttgatacgatatttgttggattcctgattatttactataatataatctagacagatagatgattcgataaatagagaaggtatatcgttggtaggataatacatccccattccagtattctcggatactctattaatgacactagttaagaacatgtcttctattctagaaaacgaaaacatcctacatggactcattaaaacttctaacgctcctgattgtgtctcgaatgcctcgtacaaggatttcaaggatgccatagattctttgaccaacgatttagaattgcgtttagcatctgatttttttattaaatcgaatggtcggctctctggtttgctaccccaatgataacaatagtcttgtaaagataaaccgcaagaaaatttatacgcatccatccaaataaccctagcaccatcggatgatattaatgtattattatagattttccatccacagttattgggccagtatactgttagcaacggtatatcgaatagattactcatgtaacctactagaatgatagttcgtgtactagtcataatatctttaatccaatctaagaaatttaaaattagattttttacactgttaaagttaacaaaggtattacccggatacgtggatatcatatatggtattggtccattatcagtaatagctccataaactgatacggcgatggtttttatatgtgtttgatctaacgaggaagaaattcgcgcccacaattcatctctagatatgtatttaatatcaaacggtaacacatcaatttcgggacgcgtatatgtttctaaatttttaatccaaatataatgatgacctatatgccctattatcatactgtcaactatagtacacctagagaacttacgatacatctgtttcctataatcgttaaattttacaaatctataacatgctaaaccttttgacgacaaccattcattaatttctgatatggaatctgtattctcaataccgtatcgttctaaagccagtgctatatctccctgttcgtgagaacgctttcgtataatatcgatcaacggataatctgaagtttttggagaataatatgactcatgatctatttcgtccataaacaatctagacataggaattggaggcgatgatcttaattttgtgcaatgagtcgtcaatcctataacttctaatattgtaatattcatcatcgacataacactatctatgttatcatcgtatattagtataccatgaccttcttcatttcgtgccaaaatgatatacagtcttaaatagttacgcaatatctcaatagtttcataattgttagctgttttcatcaaggtttgtatcctgtttaacatgatggcgttctatacgtttctattttttaaatttttaacgatttactgtggctagatacccaatctctctcaaatatttttttagcctcgcttacaagctgtttatctatactattaaaactgacgaatccgtgattttggtaatgggttccgtcgaaatttgccgaagtgatatgaacatattcgtcgtcgactatcaacaattttgtattattctgaatagtgaaaaccttcacagatagatcattttgaacacacaacgcgtctagacttctggcggttgccatagaatatacgtcgttcttatcccaattaccaactagaagtctgatcttaactcctctattaatggctgcttctataatggagttgtaaatgtcgggccaatagtagctattaccgtcgacacgtgtagtgggaactatggccaaatgttcaatatctatactagtcttagccgacttgagtttatcaataactacatcagtgtctagatctctagaatatcccaataggtgttccggagaatcagtaaagaacactccacctataggattcttaatatgatacgcagtgctaactggcagacaacaagccgcagagcataaattcaaccatgaattttttgcgctattaaaggctttaaaagtatcaaatcttctacgaagatctgtggccagcgggggataatcagaatatacacctaacgttttaatcgtatgtatagatcctccagtaaatgacgcgtttcctacataacatctttcattatctgacacccaaaaacaaccgagtagtagtcccacattattttttttatctatattaacggttataaaatttatatccgggcagtgactttgtagctctcccagatttcttttccctcgttcatctagcaaaactattattttaatccctttttcagatgcctcttttagtttatcaaaaataagcgctcccctagtcgtactcagaggattacaacaaaaagatgctatgtatatatatttcttagctagagtgataatttcgttaaaacattcaaatgttgttaaatgatcggatctaaaatccatattttctggtagtgtttctaccagcctacattttgctcccgcaggtaccggtgcaaatggccacatttagttaacataaaaacttatacatcctgttctatcaacgattctagaatatcatcggctatatcgctaaaattttcatcaaagtcgacatcacaacctaactcagtcaatatattaagaagttccatgatgtcatcttcgtctatttctatatccgtatccattgtagattgttgaccgattatcgagtttaaatcattactaatactcaatccttcagaatacaatctgtgtttcattgtaaatttataggcggtgtatttaagttggtagattttcaattatgtatcaatatagcaacagtagttcttgctcctccttgattctagcatcctcttcattattttcttctacgtacataaacatgtccaatacgttagacaacacaccgacgatggcggccgccacagacacgaatatgactaaaccgatgaccatttaaaaacccctctctagctttcacttaaactgtatcgattattcttttagaacatgtataatataaaaacattattctatttcgaatttaggcttccaaaaatttttcatccgtaaaccgataataatatatatagacttgttaatagtcggaataaatagattaatgcttaaactatcatcatctccacgattagagatacaatatttacattttttttgctgtttcgaaactttatcaatacacgttaatacaaacccaggaaggagatattgaaactgaggctgttgaaaatgaaacggtgaatacaataattcagataatgtaaaatcatgattccgtattctgatgatattagaactgctaatggatgtcgatggtatgtatctaggagtatctattttaacaaagcatcgatttgctaatatacaattatcattttgattaattgttattttattcatattcttaaaaggtttcatatttatcaattcttctacattaaaaatttccatttttaatttatgtagccccgcaatactcctcattacgtttcattttttgtctataatatccattttgttcatctcggtacatagattatccaattgagaagcgcatttagtagttttgtacattttaagtttattgacgaatcgtcgaaaactagttatagttaacattttattatttgataccctgatattaatacccctgccgttactattatttataactgatgtaatccacgtaacattggaattaactatcgatagtaatgcatcgacgcttccaaaattgtctattataaactcaccgataatttttttattacatgttttcatattcattaggattattaaatctttaatcttactacgattgtatgcgttgatattgcaagacgtcattctaaaagacggaggatctccatcaaatgccagacaatcacgtacaaagtacatggaaataggttttgttctattgcgcatcatagatttatatagaacacccgtagaaatactaatttgttttactctataaaatactaatgcatctatttcatcgttttgtataacgtctttccaagtgtcaaattccaaatttttttcattgatagtaccaaattcttctatctctttaactacttgcatagataggtaattacagtgatgcctacatgccgttttttgaaactgaatagatgcgtctagaagcgatgctacgctagtcacaatcaccactttcatatttagaatatatatatgtaaaaatatagtagaatttcattttgttttttttctatgctataaatgaattctcattttgcatctgctcatactccgttttatatcaataccaaagaaggaagatatctggttctaaaagccgttaaagtatgcgatgttagaactgtagaatgcgaaggaagtaaagcttcctgcgtactcaaagtagataaaccctcatcacccgcgtgtgagagaagaccttcgtccccttccagatgcgagagaatgaataacccaggaaaacaagttccgtttatgaggacggacatgctacaaaatatgttcgcggctaatcgcgataatgtagcttctagacttttgtcctaaaatacaattatatccttttcgatattaataaatccgtgtcgtccaggttttttatctctttcagtatgtgaatagataggtattttatctctattcatcatcgaatttaagagatccgataaacattgtttgtattctccagatgtcagcatctgatacaacaatatatgtgcacataaacctctggcacttatttcatgtaccttccccttatcactaaggagaatagtatttgagaaatatgtatacatgatattatcatgaattagatatacagaatttgtaacactctcgaaatcacacgatgtgtcggcgttaagatctaatatatcactcgataacacattttcatctagatacactagacattttttaaagctaaaatagtctttagtagtaacagtaactatgcgattattttcatcgatgatacatttcatcggcatattattacgcttaccatcaaagactataccatgtgtatatctaacgtattctagcatggttgccatacgcgcattaaacttttcaggatctttggatagatcttccaatctatctatttgagaaaacatttttatcatgttcaatagttgaaacgtcggatccactatatagatattatctataaagattttaggaactacgttcatggtatcctggcgaatattaaaactatcaatgatatgattatcgttttcatcttttatcaccatatagtttctaagatatgggattttacttaatataatattatttcccgtaataaattttattagaaatgccaaatctataagaaaagtcctcgaattagtttgaagaatatctatatcgccgtaccgtatatttggattaattagatatagagaatatgatccgtaacatatacaacttttattatggcgtctaagatattcttccatcaacttattaacatttttgactagggaagatacattatgacgtcccattacttttgccttgtctattactgcgacgttcatagaatttagcatatctcttgccaattcttccattgatgttacattataagaaattttagatgaaattacatttggagctttaatagtaagaactcctaatatgtccgtgtatgtggtcactaatacagattgtagttctataatcgtaaataatttacctatattatatgtttgagtctgtttagaaaagtagctaagtatacgatcttttatttctgatgcagatgtatcaacatcggaaaaaaatctttttttattcttttttactaaagatacaaatatgtctttgttaaaaacagttattttctgaatatttctagcttgtaattttaacatatgatattcgttcacactaggtactctgcctaaataggtttctataatctttaatgtaatattaggaaaagtattctgatcaggattcctattcattttgaggatttaaaactctgattattgtctaatatggtctcaacacaaactttttcacagagcgatagagtttttgataactcgtttttcttaagaaatataaaactactgtctccagagctcgctctatcttttattttatttaattcgatacaaactcctgatactggttcagaaagtaattcattaattttcagtcctttatagaagatatttaatatagataatacaaaatcttcagtttttgatatcgatctgattgatcctagaactagatatattaataacgtgctcattaggcagtttatggcagcttgataattagatatagtatattccagttcatatttattagataccgcattgcccagattttgatattctatgaattcctctgaaaataaatccaaaataactagacattctattttttgtggattagtgtactctcttccctctatcatgttcactactggtgtccacgatgataaatatctagagggaatataatatagtccataggatgccaatctagcaatgtcgaataactgtaattttattcttcgctcttcattatgaattgattcttgaggtataaacctaacacaaattatattattagacttttcgtatgtaatgtctttcatgttataagtttttaatcctggaatagaatctattttaatgaggcttttaaacgcagagttctccaacgagtcaaagcataatactctgttggttttcttatatacgatgttacgattttcttctttgaatggaataggtttttgaattagtttataattacaacataatagataaggaagtgtgcaaatagtacgcggaaaaaacataatagctcccctgttttcatccatggttttaagtaaatgatcactggcttctttagtcaatggatattcgaacattaaccgtttcatcatcattggacagaatccatatttcttaatgtaaagagtgatcaaatcattgtgtttattgtaccatcttgttgtaaatgtgtattcggttatcggatctgctcctttttctattaaagtatcgatgtcgatctcgtctaagaattcaactatatcgacatatttcatttgtatacacataaccattactaacgtagaatgtataggaagagatgtaacgggaacagggtttgttgattcgcaaactattctaatacataattcttctgttaatacgtcttgcacgtaatctattatagatgccaagatatctatataattattttgtaagatgatgttaactatgtgatctatataagtagtgtaataattcatgtatttcgatatatgttccaactctgtctttgtgatgtctagtttcgtaatatctatagcatcctcaaaaaatatattcgcatatattcccaagtcttcagttctatcttctaaaaaatcttcaacgtatggaatataataatctattttacctcttctgatatcattaatgatatagtttttgacactatcttctgtcaattgattcttattcactatatctaagaaacggatagcgtccctaggacgaactactgccattaatatctctattatagcttctggacataattcatctattataccagaattaatgggaactattccgtatctatctaacatagttttaagaaagtcagaatctaagacctgatgttcatatattggttcatacatgaaatgatctctattgatgatagtgactatttcattctctgaaaattggtaactcattctatatatgctttccttgttgatgaaggatagaatatactcaatagaatttgtaccaacaaactgttctcttatgaatcgtatatcatcatctgaaataatcatgtaaggcatacatttaacaattagagacttgtctcctgttatcaatatactattcttgtgataatttatgtgtgaggcaaatttgtccacgttctttaattttgttatagtagatatcaaatccaatggagctacagttcttggcttaaacagatatagtttttctggaacgaattctacaacattattataaaggactttgggtagataagtgggatgaaatcctattttaattaatgcgatagccttgtcctcgtgcagatatccaaacgcttttgtgatagtatggcattcattgtctagaaacgctctacgaatatctgtgacagatatcatctttagagaatatactagtcgcgttaatagtactacaatttgtattttttaatctatctcaataaaaaaattaatatgtatgattcaatgtataactaaactactaactgttattgataactagaatcagaatctaatgatgacgtaaccaagaagtttatctactgccaatttagctgcattatttttagcatctcgtttagattttccatctgccttatcgaatactcttccgtcgatatctacacaggcataaaatgtaggagagttactaggccccactgattcaatacgaaaagaccaatctctcttagttatttggcagtactcattaataatggtgacagggttagcatctttccaatcaataatttttttagccggaataacatcatcaaaagacttatgatcctctctcattgatttttcgcgggatacatcatctattatggcgtcagccataacatcagcatccggcttatccgcctccgttgtcataaaccaacgaggaggaatatcgtcggagctgtacaccatagcactacgttgaagatcgtacagagctttattaacttctcgcttctccatattaagttgtctagttagttgtgcagcagtagctccttcgattccaatgtttttaatagccgcacacacaatctctgcgtcagaacgctcgtcaatatagatcttagacatttttagagagaactaacacaaccagcaataaaactaatttattttatcatttttttattcatcatcctctggtggttcgtcgtttctatcgaatgtggatctgattaacccgtcatctataggtgatgctggttctggagattctggaggagatggattattatctggaagaatctctgttatttccttgttttcatgtatcgattgcgttgtaacattaagattgcgaaatgctctaaatttgggaggcttaaagtgttgtttgcaatctctacacgcatgtctaactagtggaggttcgtcagcggctctagtttgaatcatcatcggcgtagtattcctacttttacagttaggacacggtgtattgtatttctcgtcgagaacgttaaaataatcgttgtaactcacatcctttattttatctatattgtattctactcctttcttaatgcattttataccgaataagagatagcgaaggaattctttttcggtgccgctagtacccttaatcatatcacatagtgttttatattccaaatttgtggcaatagacggtttatttctatacgatagtttgtttctggaatcctttgagtattctataccaatattattctttgattcgaatttagtttcttcgatattagattttgtattacctatattcttgatgtagtactttgatgatttttccatggcccattctattaagtcttccaagttggcatcatccacatattgtgatagtaattctcggatatcagtagcggctaccgccattgatgtttgttcattggatgagtaactactaatgtatacattttccatttataacacttatgtattaactttgttcatttatattttttcattattatgttgatattaacaaaagtgaatatatatgttaataattgtattgtggttatacggctacaatttcataatgagtggaagtcagtgtccgatgatcaatgacgatagctttactctgaaaagaaagtatcaaatcgatagtgcggagtcaacaataaaaatggataagaagaggataaagtttcagaatagagccaaaatggtaaaagaaataaatcagacaataagagcagcacaaactcattacgagacattgaaactaggatacataaaatttaagagaatgattaggactactactctagaagatatagcaccatctattccaaataatcagaaaacttataaactattctcggacatttcagccatcggcaaagcatcacagaatccgagtaagatggtatatgctctgctgctttacatgtttcccaatttgtttggagatgatcatagattcattcgttatagaatgcatccaatgagtaaaatcaaacacaagatcttctctcctttcaaacttaatcttattagaatattagtggaagaaagattctataataatgaatgcagatctaataaatggagaataattggaacacaagttgataaaatgttgatagctgaatctgataaatatacaatagatgcaaggtataacctaaaacccatgtatagaatcaagggaaaatctgaagaagataccctctttatcaaacagatggtagaacaatgtgtgacatcccaggaattggtggaaaaagtgttgaagatactgtttagagatttgttcaagagtggagaatacaaagcgtacagatacgatgatgatgtagaaaatggatttattggattggatacactaaaattaaacattgttcatgatatagttgaaccatgtatgcctgttcgtaggccagtggctaagatactgtgtaaagaaatggtaaataaatactttgagaatccgctacatattattggtaaaaatcttcaagagtgcattgactttgttagtgaataggcatttcatctttctccaatactaattcaaattgttaaattaataatggatagtataaatagttattagtgataaaatagtaaaaataattattagaataagagtgtagtatcatagataactctcttctataaaaatggattttattcgtagaaagtatcttatatacacagtagaaaataatatagattttttaaaggatgatacattaagtaaagtaaacaattttaccctcaatcatgtactagctctcaagtatctagttagcaattttcctcaacacgttattactaaggatgtattagctaataccaatttttttgttttcatacatatggtacgatgttgtaaagtgtacgaagcggttttacgacacgcatttgatgcacccacgttgtacgttaaagcattgactaagaattatttatcgtttagtaacgcaatacaatcgtacaaggaaaccgtgcataaactaacacaagatgaaaaatttttagaggttgccgaatacatggacgaattaggagaacttataggcgtaaattatgacttagttcttaatccattatttcacggaggggaacccatcaaagatatggaaatcatttttttaaaactgtttaagaaaacagacttcaaagttgttaaaaaattaagtgttataagattacttatttgggcttacctaagcaagaaagatacaggcatagagtttgcggataatgatagacaagatatatacactctatttcaacaaactggtagaatagtccatagcaatctaacagaaacgtttagagattatatctttcccggagataagactagctattgggtgtggttaaacgaaagtatagctaatgatgcggatattgttcttaatagacacgccattaccatgtatgataaaattcttagttatatatactctgagataaaacaaggacgcgttaataaaaacatgcttaagttagtttatatctttgagcctgaaaaagatatcagagaacttctgctagaaatcatatatgatattcctggagatatcctatctattattgatgcaaaaaacgacgattggaaaaaatattttattagtttttataaagctaattttattaacggtaatacatttattagtgatagaacgtttaacgaggacttattcagagttgttgttcaaatagatcccgaatatttcgataatgaacgaattatgtctttattctctacgagtgctgcggacattaaacgatttgatgagttagatattaataacagttatatatctaatataatttatgaggtgaacgatatcacattagatacaatggatgatatgaagaagtgtcaaatctttaacgaggatacgtcgtattatgttaaggaatacaatacatacctgtttttgcacgagtcggatcccatggtcatagagaacggaatactaaagaaactgtcatctataaaatccaagagtagacggctgaacttgtttagcaaaaacattttaaaatattatttagacggacaattggctcgtctaggtcttgtgttagatgattataaaggagacttgttagttaaaatgataaaccatcttaagtctgtggaggatgtatccgcattcgttcgattttctacagataaaaaccctagtattcttccatcgctaatcaaaactattttagctagttataatatttccatcatcgtcttatttcaaaggtttttgagagataatctatatcatgtagaagaattcttggataaaagcatccatctaaccaagacggataagaaatatatacttcaattgataagacacggtagatcatagaacagaccaaatatattattaataatttgtatatacatagatataattatcacacatttttgataaatgggaactgctgcaacaattcagactcccaccaaattaatgaataaagaaaatgcagaaatgattttggaaaaaattgttgatcatatagttatgtatattagtgacgaatcaagtgattcagaaaataatcctgaatatattgattttcgtaacagatacgaagactatagatctctcattataaaaagtgatcacgagtttgtaaagctatgtaaaaatcatgcagagaaaagttctccagaaacgcaacaaatgattatcaaacacatatacgaacaatatcttattccagtatctgaagtactattaaaacctataatgtccatgggtgacataattacatataacggatgtaaagacaatgaatggatgctagaacaactctctaccctaaactttaacaatctccgcacatggaactcatgtagcataggcaatgtaacgcgtctgttttatacattttttagttatctgatgaaagataaactaaatatataagtataatcccattctaatactttaacctgatgtattacctgcatcttattagaatattaacctaactaaaagacataacatagttgataaaaagcggtaggatataaatattatggctgccaccgttccgcgttttgacgacgtgtacaaaaatgcacaaagaagaattctagatcaagaaacattttttagtagaggtctaagtagaccgttaatgaaaaacacatatctatttgataattacgcgtatggatggataccagaaactgcaatttggagtagtagatacgcaaacttagatgcaagtgactattatcccatttcgttgggattacttaaaaagttcgagtttctcatgtctctatataaaggtcctattcccgtatatgaagaaaaagtaaatactgaattcattgctaatggatcgttctctggtagatacgtatcatatcttcgaaagttttctgcccttccaacaaacgagtttattagttttttgttactgacttccattccaatctataatatcttgttctggtttaaaaatactcagtttgatattactaaacacacattattcagatacgtctatacagataatgccaaacacctggcgttggctaggtatatgcatcaaacaggagactataagcctttgtttagtcgtctcaaagagaattatatatttaccggtcccgttccaataagtatcaaagatatagatcaccctaatcttagtagagcaagaagtccatccgattatgagacattagctaatattagtactatattgtactttaccaagtatgatccggtattaatgtttttattgttttacgtacctgggtattcaattactacaaaaattactccagccgtagaatatctaatggataaactgaatctaacaaagagcgacgtacaactgttgtaaattattttatgcttcgtaaaatgtaggttttgaaccaaacattctttcaaagaatgagatgcataaaactttattatccaatagattgactatttcggacgtcaatcgtttaaagtaaacttcgtaaaatattctttgatcactgccgagtttaaaacttctatcgataattgtttcatatgttttaatatttacaagttttttggtccatggtacattagccggacaaatatatgcaaaataatatcgttctccaagttctatagtttctggattatttttattatattcagtaaccaaatacatattagggttatctgcggatttataatttgagtgatgcattcgactcaacataaataattctagaggagacgatctactatcaaattcggatcgtaaatctgtttctaaagaacggagaatatctatacatacctgattagaattcatccgtccttcagacaacatctcagacagtctggtcttgtatgtcttaatcatattcttatgaaacttggaaacatctcttctagtttcactagtacctttattaattctctcaggtacagattttgaattcgacgatgctgagtatttcatcgttgtatatttcttcttcgattgcataatcagattcttatataccgcctcaaactctattttaaaattattaaacaatactctattattaatcagtcgttctaactctttcgctatttctatagacttatcgacatcttgactgtctatctctgtaaacacggagtcggtatctccatacacgctacgaaaacgaaatctgtaatctataggcaacgatgttttcacaatcggattaatatctctatcgtccatataaaatggattacttaatggattggcaaaccgtaacataccgttagataactctgctccatttagtaccgattctagatacaagatcattctacgtcctatggatgtgcaactcttagccgaagcgtatgagtatagagcactatttctaaatcccatcagaccatatactgagttggctactatcttgtacgtatattgcatggaatcatagatggccttttcagttgaactggtagcctgttttagcatctttttatatctggctctctctgccaaaaatgttcttaatagtctaggaatggttccttctatcgatctatcgaaaattgctatttcagagatgaggttcggtagtctaggttcacaatgaaccgtaatatatctaggaggtggatatttctgaagcaagagctgattatttatttcttcttccaatctattggtactaacaacgacaccgactaatgtttccggagatagatttccaaagatacacacattaggatacagactgttataatcaaagattaatacattattactaaacattttttgttttggagcaaataccttaccgccttcataaggaaacttttgttttgtttctgatctaactaagatagttttagtttccaacaatagctttaacagtggacccttgatgactgtactcgctctatattcgaataccatggattgaggaagcacatatgttgacgcacccgcgtctgtttttgtttctactccataatactcccacaaatactgacacaaacaagcatcatgaatacagtatctagccatatctaaagctatgtttagattataatccttatacatctgagctaaatcaacgtcatcctttccgaaagataatttatatgtatcattaggtaaagtaggacatgatagtacgactttaaatccattttcccaaatatctttacgaattactttacatataatatcctcatcaacagtcacataattacctgtggttaaaacctttgcaaatgcagcggctttgcctttcgcgtccgtagtatcgtcaccgatgaacgtcatttctctaactcctctatttaatactttacccatgcaactgaacgcgttcttggatatagaatccaatttgtacgaatccaatttttcagatttttgaatgaatgaatatagatcgaaaaatatagttccattattgttattaacgtgaaacgtagtattggccatgccgcctactcccttatgactagactgatttctctcataaatacagagatgtacagcttcctttttgtccggagatctaaagataatcttctctcctgttaataactctagacgattagtaatatatctcagatcaaagttatgtccgttaaaggtaacgacgtagtcgaacgttagttccaacaattgtttagctattcgtaacaaaactatttcagaacatagaactagttctcgttcgtaatccatttccattagtgactgtatcctcaaacatcctctatcgacggcttcttgtatttcctgttccgttaacatctcttcattaatgagcgtaaacaataatcgtttaccacttaaatcgatataacagtaacttgtatgcgagattgggttaataaatacagaaggaaacttcttatcgaagtgacactctatatctagaaataagtacgatcttgggatatcgaatctaggtatttttttagcgaaacagttacgtggatcgtcacaatgataacatccattgttaatctttgtcaaatattgctcgtccaacgagtaacatccgtctggagatatcccgttagaaatataaaaccaactaatattgagaaattcatccatggtggcattttgtatgctgcgtttctttggctcttctatcaaccacatatctgcgacggagcattttctatctttaatatctagattataacttattgtctcgtcaatgtctatagttctcatctttcccaacggcctcgcattaaatggaggaggagacaatgactgatatatttcgtccgtaactacgtaataaaagtaatgaggaaatcgtataaatacggtctcgccatttcgacatctggatttcagatataaaaatctgttttcaccgtgactttcaaaccaattaatgcaccgaacatccatttatagaatttagaaatatattttcatttaaatgaatcccaaacattggggaagagccgtatggaccattatttttatagtactttcgcaagcgggtttagacggcaacatagaagcgtgtaaacgaaaactatatactatagtcagcactcttccatgtcctgcatgtagacggcacgcgactatcgctatagaggacaataatgtcatgtctagcgatgatctgaattatatttattattttttcatcagattatttaacaatttggcatctgatcccaaatacgcgatcgatgtgacaaaggttaaccctttataaacttaacccattataaaacttatgattagtcacgactgaaataaccgcgtgattattttttggtataattctacacggcatggtttctgtaactatgaattcaacccccgttacattagtgaaatctttaacaaacagcaagggttcgtcaaagacataaaactcattgtttacaatcgaaatagaccccctatcacacttaaaataaaaaatatccttatcctttaccaccaaataaaattctgattggtcaatgtgaatgtattcacttaacagttccacaaatttatttattaactccgaggcacatacatcgtcggtattttttatggcaaactttactcttccagcatccgtttctaaaaaaatattaacgagttccatttatatcatccaatattattgaaatgacgttgatggacagatgatacaaataagaaggtacggtacctttgtccaccatctcctccaattcatgctctattttgtcattaactttaatgtatgaaaacagtacgccacatgcttccatgacagtgtgtaacactttggatacaaaatgtttgacattagtataattgtccaagactgtcaatctataatagatagtagctataatatattctatgatggtattgaagaagatgacaatcttggcatattgatcatttaacacagacatggtatcaacagatagcttgaatgaaagagaatcagtaattggaataagcgtcttctcgatagagtgtccgtataccaacatgtctgatattttgatgtattccattaaattatttagttttttctttttattctcgttaaacagcatttctgtcaacggaccccaacatcgttgaccgattaagttttgattgatttttccgtgtaaggcgtatctagtcagatcgtatagcctatccaataatccatcatctgtgcgtagatcacatcgtacactttttaattctctatagaagagcgacagacagcaatttctttattctctacagatgtaagatacttgaagacattcctatgatgatgcagaattttggataacacggtattgatggtatctgttaccataattcctttgatggctgatagtgtcagagcacaagatttccaatctttgttttgatatctatatcagacagcatggtgcgtctgacaacacaaggattaagacggaaagatgaaatgattctctcaacatcttcaatggataccttgctattttttctggcattatctatatgtgcgagaatatcctctagagaatcagtatcctttttgatgatagtggatctcaatgacatgggacgtctaaaccttcttattctatcaccagattgcatggtgatttgtcttctttcttttatcataatgtaatctctaaattcatcggcaaattgtctatatctaaaatcataatatgagatgtttacctctacaaatatctgttcgtccaatgttagagtatctacatcagttttgtattccaaattaaacatggcaacggatttaattttatattcctctattaagtcctcgtcgataataacagaatgtagataatcatttaatccatcgtacatggttggaagatgcttgttgacaaaatctttaattgtcttgatgaaggtgggactatatctaacatcttgattaataaaatttataacattgtccataggatactttgtaactagttttatacacatctcttcatcggtaagtttagacagaatatcgtgaacaggtggtatattatattcatcagatatacgaagaacaatgtccaaatctatattgtttaatatattatatagatgtagcgtagctcctacaggaatatctttaactaagtcaatgatttcatcaaccgttagatctattttaaagttaatcatataggcattgatttttaaaaggtatgtagccttgactacattctcattaattaaccattccaagtcactgtgtgtaagaagattatattctatcataagcttgactacatttggtcccgataccattaaagaattcttatgatataaggaaacagattttaggtactcatctactctacaagaattttggagagccttaacgatatcagtgacgtttattatttcaggaggaaagaatctaacattgagaatatcggaattaatagcttccagatacagtgattttggcaatagtccgtgtaatccataatccagtaacacgagctggtgcttgctagacaccttttcaatgtttaatttttttgaaataagctttgataaagccttcctcgcaaattccggatacatgaacatgtcggcgacatgattaagtattgttttttcattattttctcaacaagttctcaataccccaatagatgatagaatatcacccaatgcgtccatgttgtctatttccaacaggtcgctatatccaccaatagaagtttttccaaaaaagattctaggaacagttctaccaccagtaatttgttcaaaatagtcacgcaattcattttcgggtttaaattctttaatatcgacaatttcatacgctcctcttttgaaactaaacttatttagaatatccagtgcatttctacaaaaaggacatgtatacttgacaaaaattgtcactttgttattggccaacctttgttgtacaaattcctcggccattttaatatttaagtgatataaaactatctcgacttatttaactctttagtcgagatatatggacgcagatagctatatgatagccaactacagaaggcaaacgctataaaaaacataattacgacgagcatatttataaatatttttattcagcattacttgatatagtaatattaggcacagtcaaacattcaaccactctcgatacattaactctctcattttctttaacaaattctacaatatcttcgtaaaaagattcttgaaactttttagaatatctatcgactctagatgaaatagcgttcgtcaacatactatgttttgtatacataaaggcgcccattttaacagtttctagtgacaaaatgctagcgatcctaggatcctttagaatcacatagattgacgattcgtctctcttagtaactctagtaaaataatcatacaatctagtacgcgaaataatattatccttgacttgaggagatctaaacaatctagttttgagaacatcgataagttcatcgggaatgacatacatactatctttaatagaactcttttcatccagttgaatggattcgtccttaaccaactgattaatgagatcttctattttatcattttccagatgatatgtatgtccattaaagttaaattgtgtagcgcttctttttagtctagcagccaatactttaacatcactaatatcgatatacaaaggagatgatttatctatggtattaagaattcgtttttcgacatctgtcaaaaccaattcctttttgcctgtatcatccagttttccatcctttgtaaagaaattattttctactagactattaataagactgataaggattcctccataattgcacaatccaaactttttaacaaaactagactttacaagatctacaggaatgcgtaattcaggtttcttagcttgtgattttttcttttgtggacattttcttgtgaccaactcatctaccatttcattgattttagcagtgaaataagctttcaatgcacgggcactgatactattgaaaacgagttgatcttcaaattccgccatttaagttcaccaaacaacttttaaatacaaatatatcaatagtagtagaataagaactataaaaaaaataataattaaccaataccaaccccaacaaccggtattattagttgatgtgactgttttctcatcacttagaacagatttaacaatttctataaagtctgtcaaatcatcttccggagaccccataaatacaccaaatatagcggcgtacaacttatccatttatacattgaatattggcttttctttatcgctatcttcatcatattcatcatcaatatcaacaagtcccagattacgagccagatcttcttctacattttcagtcattgatacacgttcactatctccagagagtccgataacgttagccaccacttctctatcaatgattagtttcttgagtgcgaatgtaatttttgtttccgttccggatctatagaagacgataggtgtgataattgccttggccaattgtctttctcttttactgagtgattctagttcaccttctatagatctgagaatggatgattctccagtcgaaacatattctaccatggatccgtttaatttgttgatgaagatggattcatccttaaatgttttctctgtaatagtttccaccgaaagactatgcaaagaatttggaatgcgttccttgtgcttaatgtttccatagacggcttctagaagttgatacaacataggactagccgcggtaacttttatttttagaaagtatccatcgcttctatcttgtttagatttatttttataaagtttagtctctccttccaacataataaaagtggaagtcatttgactagataaactatcagtaagttttatagagatagacgaacaattagcgtattgagaagcatttagtgtaacgtattcgatacattttgcattagatttactaatcgattttgcatactctataacacccgcacaagtctgtagagaatcgctagatgcagtaggtcttggtgaagtttcaactctcttcttgattaccttactcatgattaaacctaaataattgtactttgtaatataatgatatatattttcactttatctcatttgagaataaaaatgtttttgtttaaccactgcatgatgtacagatttcggaatcgcaaaccaccagtggttttattttatccttgtccaatgtgaattgaatgggagcggatgcgggtttcgtacgtagatagtacattcccgtttttagaccgagactccatccgtaaaaatgcatactcgttagtttggaataactcggatctgctatatggatattcatagattgactttgatcgatgaaggctcccctgtctgcagccatttttatgatcgtcttttgtggaatttcccaaatagttttataaactcgcttaatatcttctggaaggtttgtattctgaatggatccaccatctgccataatcctattcttgatctcatcattccataattttctctcggttaaaactctaaggagatgcggattaactacttgaaattctccagacaatactctccgagtgtaaatattactggtatacggttccaccgactcattatttcccaaaatttgagcagttgatgcagtcggcataggtgccaccaataaactatttctaagaccgtatgttctgattttatcttttagaggttcccaattccaaagatccgacggtacaacattccaaagatcatattgtagaataccgttactggcgtacgatcctacatatgtatcgtatggtccttccttctcagctagttcacaactcgcctctaatgcaccgtaataaatggtttcgaagatcttcttatttagatcttgtgcttccaggctatcaaatggataatttaagagaataaacgcgtccgctaatccttgaacaccaataccgataggtctatgtctcttattagagatttcagcttctggaataggataataattaatatctataattttattgagatttctgacaattactttgaccacatccttcagtttgagaaaatcaaatcgcccatctattacaaacatgttcaaggcaacagatgccagattacaaacggctacctcattagcatccgcatattgtattatctcagtgcaaagattactacacttgatagttcctaaattttgttgattactctttttgttacacgcatccttataaagaatgaatggagtaccagtttcaatctgagattctataatcgctttccagacgactcgagcctttattatagatttgtatctcctttctctttcgtatagtgtatacaatcgttcgaactcgtctccccaaacattgtccaatccaggacattcatccggacacatcaacgaccactctccgtcatccttcactcgtttcataaagagatcaggaatccaaagagctataaatagatctctggttctatgttcctcgtttcctgtattctttttaagatcgaggaacgccataatatcagaatgccacggttccaagtatatggccataactccaggccgtttgtttcctccctgatctatgtatctagcggtgttattataaactctcaacattggaataataccgtttgatataccattggtaccggagatatagcttccactggcacgaatattactaattgatagacctattccccctgccattttagagattaatgcgcatcgttttaacgtgtcatagataccctctatgctatcatcgatcatgttaagtagaaaacagctagacatttggtgacgactagttcccgcattaaataaggtaggagaagcgtgcgtaaaccatttttcagaaagtagattgtacgtctcaatagctgagtctatatcccattgatgaattcctactgcgacacgcattaacatgtgctgaggtctttcaacgatcttgttgtttattttcaacaagtaggatttttccaaagttttaaaaccaaaatagttgtatgaaaagtctcgttcgtaaataataaccgagttgagtttatccttatatttgttaactatatccatggtgatacttgaaataatcggagaatgtttcccatttttaggattaacatagttgaataaatcctccatcacttcactaaatagtttttttgtttccttgtgtagatttgatacggctattctggcggctagaatggcataatccggatgttgtgtagtacaagtggctgctatttcggctgccagagtgtccaattctaccgttgttactccattatatattccttgaataaccttcatagctattttaataggatctatatgatccgtgtttaagccataacataattttctaatacgagacgtgattttatcaaacatgacattttccttgtatccatttcgtttaatgacaaacatttttgttggtgtaataaaaaaaattatttaacttttcattaatagggatttgacgtatgtagcgtacaaaattatcgttcctggtatatagataaagagtcctatatatttgaaaatcgttacggctcgattaaactttaatgattgcatagtgaatatatcattaggatttaactccttgactatcatggcggcgccagaaattaccatcaaaagcattaatacagttatgccgatcgcagttagaacggttatagcatccaccatttatatctaaaaattagatcaaagaatatgtgacaaagtcctagttgtatactgagaattgacgaaacaatgtttcttacatattttttttttattagtaaccgacttaatagtaggaactggaaaactagacttgattattctataagtatagatacccttccaaataatattctctttgataaaagttccagaaaatgtagaattttttaaaaagttatcttttgctattaccaagattgtgtttagacgcttattattaatatgagtgatgaaatccacaccgcctctagatatcgcttttatttccacattagatggtaaatccaatagtgaaactatctttttaggaatgtatggactcgcgtttagaggagtgaacgtcttaggcgtcggaaaggatgattcatcaaacgaataaacaatttcacaaatggatgttaatgtattagtaggaaattttttgacgctagtggaattgaagattctaatggatgatgttctacctatttcatccgataacatgttaatttccgacaccaacggttttaatatttcgatgatatacggtagtctctctttcggacttatatagcttattccacaatacgagtcattatatactccaaaaaacaaaataactagtataaaatctgtatcgaatgggaaaaacgaaattatcgacataggtatagaatctggaacattgaacgtattaatacttaattctttttctgtggtaagtaccgataggttattgacattgtatggttttaaatattctataacttgagacttgatagatattagtgatgaattgaaaattatttttatcaccacgtgtgtttcaggatcatcgtcgacgcccgtcaaccaaccgaatggagtaaaataaatatcattaatatatgctctagatattagtatttttatcaatcctttgattatcatcttctcgtaggcgaatgattccatgatcaagagtgatttaagaacatcctccggagtattaatgggcttagtaaacagtccatcgttgcaataataaaagttatccaagttaaaggatattatgcattcgtttaaagatatcacctcatctgacggagacaattttttggtaggttttagagactttgaagctacttgtttaacaaagttattcatcgtcgtttactattctatttaattttgtagttaatttatcacatatcacattaattgactttttggtccatttttccatacgtttatattcttttaatcctgcgttatccgtttccgttatatccagggatagatcttgcaagttaaatagaatgctcttaaataatgtcattttcttatccgctaaaaatttaaagaatgtataaacctttttcagagatttgaaactcttaggtggtgtcctagtacacaatatcataaacaaactaataaacattccacattcagattccaacagctgattaacttctacattaatacagcctattttcgctccaaatgtacattcgaaaaatctgaataaaacatcgatgtcacaatttgtattatccaatacagaatgtttgtgattcgtgttaaaaccatcggagaaggaataaaaataaaaattattatagtggtggaattcagttggaatattgcctccggagtcataaaaggatactaaacattgttttttatcataaattacacatttccaatgagacaaataacaaaatccaaacattacaaatctagaggtagaacttttaattttgtctttaagtatatacgataagatatgtttattcataaacgcgtcaaatttttcatgaatcgctaaggagtttaagaatctcatgtcaaattgtcctatataatccacttcggatccataagcaaactgagagactaagttcttaatacttcgattgctcatccaggctcctctctcaggctctattttcatcttgacgacctttggattttcaccagtatgtattcctttacgtgataaatcatcgattttcaaatccatttgtgagaagtctatcgccttagatactttttcccgtagtcgaggtttaaagaaatacgctaacggtatactagtaggtaactcaaagacatcatatatagaatggtaacgcgtctttaactcgtcggttaactctttcttttgatcgagttcgtcgctactattgggtctgctcaggtgccccgactctactagttccaacatcataccgataggaatacaagacactttgccggcggttgtagatttatcatatttctccactacatatccgttacaatttgttaaaaatttagatacatctatattgctacataatccagctagtgaatatatatgacataataaattggtaaatcctagttctggtattttactaattactaaatctgtatatctttccatttatcatggaaaagaatttaccagatatcttcttttttccaaactgcgttaatgtattctcttacaaatattcacaagatgaattcagtaatatgagtaaaacggaacgtgatagtttctcattggcggtgtttccagttataaaacatagatggcataacgcacacgttgtaaaacataaaggaatatacaaagttagtacagaagcacgtggaaaaaaagtatctcctccatcactaggaaaacccgcacacataaacctaaccgcgaagcaatatatatacagtgaacacacaataagctttgaatgttatagttttctaaaatgtataacaaatacagaaatcaattcgttcgatgagtatatattaagaggactattagaagctggtaatagtttacagatattttccaattccgtaggtaaacgaacagatactataggtgtactagggaataagtatccatttagcaaaattccattggcctcattaactcctaaagcacaacgagagatattttcagcgtggatttctcatagacctgtagttttaactggaggaactggagtgggtaagacgtcacaggtacccaagttattgctttggtttaattatttatttggtggattctctactctagataaaatcactgactttcacgaaagaccagtcattctatctcttcctaggatagctttagttagattgcatagcaataccattttaaaatcattgggatttaaggtactagatggatctcctatttctttacggtacggatctataccggaagaattaataaacaaacaaccaaaaaaatatggaattgtattttctacccataagttatctctaacaaaactatttagttatggcactcttattatagacgaagttcatgagcatgatcaaataggagatattattatagcagtagcgagaaagcatcatacgaaaatagattctatgtttttaatgactgccacgttagaggatgacagggaacggctaaaagtatttttacctaatcccgcatttatacatattcctggagatacactgtttaaaattagcgaggtatttattcataataagataaatccatcttccagaatggcatacatagaagaagaaaagagaaatttagttactgctatacagatgtatactcctcctgatggatcatccggtatagtctttgtggcatccgttgcacagtgtcacgaatataaatcatatttagaaaaaagattaccgtatgatatgtatattattcatggtaaggtcttagatatagacgaaatattagaaaaagtgtattcatcacctaatgtatcgataattatttctactccttatttggaatccagcgttactatacgcaatgttacacacatttatgatatgggtagagtttttgtccccgctccttttggaggatcgcaagaatttatttctaaatctatgagagatcaacgaaaaggaagagtaggaagagttaatcctgggacatacgtatatttctatgatctgtcttatatgaagtctatacagcgaatagattcagaatttctacataattatatattgtacgctaataagtttaatctaacactccccgaagatttgtttataatccctacaaatttggatattctatggcgtacaaaggaatatatagactcgttcgatattagtacagaaacatggaataaattattatccaattattatatgaagatgatagagtatgctaaactttatgtactaagtcctattctcgctgaggagttggataattttgagaggacgggagaattaactagtattgtacaagaagccattttatctctaaatttacgaattaagattttaaattttaaacataaagatgatgatacgtatatacacttttgtaaaatattattcggtgtctataacggaacaaacgctactatatattatcatagacctctaacgggatatatgaatatgatttcagatactatatttgttcctgtagataataactaaaaatcaaactctaatgaccacatctttttttagagatgaaaaattttccacatctccttttgtagacacgactaaacattttgcagaaaaaagtttattagtgtttagataatcgtatacttcatcagtgtagatagtaaatgtgaacagataaaaggtattcttgctcaatagattggtaaattccatagaatatattaatcctttcttcttgagatcccacatcatttcaaccagagacgttttatccaatgatttacctcgtactataccacatacaaaactagattttgcagtgacgtcgtatctggtattcctaccaaacaaaattttacttttagttcttttagaaaattctaaggtagaatctctatttgccaatatgtcatctatggaattaccactagcaaaaaatgatagaaatatatattgatacatcgcagctggttttgatctactatactttaaaaacgaatcagattccataattgcctgtatatcatcagctgaaaaactatgttttacacgtattccttcggcatttctttttaatgatatatcttgtttagacaatgataaagttatcatgtccatgagagacgcgtctccgtatcgtataaatatttcattagatgttagacgcttcattaggggtatacttctataaggtttcttaatcagtccatcattggttgcgtcaagaactactatcggatgttgttgggtatctctagtgttacacatggccttactaaagtttgggtaaataactatgatatctctattaattatagatgcatatatttcatttgtcaaggatattagtatcgacttgctatcgtcattaatacgtgtaatgtaatcatataaatcatgcgatagccaaggaaaatttaaatagatgttcatcatataatcgtcgctataattcatattaatacgttgacattgactaatttgtaatatagcctcgccacgaagaaagctctcgtattcagtttcatcgataaaggataccgttaaatataactggttgccgatagtctcatagtctattaagtggtaagtttcgtacaaatacagaatccctaaaatattatctaatgttggattaatctttaccataactgtataaaatggagacggagtcataactattttaccgtttgtacttactggaatagacgaaggaataatctccggacatgctggtaaagacccaaatgtctgtttgaagaaatccaatgttccaggtcctaatctcttaacaaaaattacgatattcgatcccgatatcctttgcattctatttaccagcatatcacgaactatattaagattatctatcatgtctattctcccaccgttatataaatcgcctccgctaagaaacgttagtatatccatacaatggaatacttcatttctaaaatagtattcgttttctaattctttaatgtgaaatcgtatactagaaagggaaaaattatctttgagttttccgttagaaaagaaccacgaaactaatgttctgattgcgtccgattccgttgctgaattaatggatttacaccaaaaactcatataacttctagatgtagaagcattcgctaaaaaattagtagaatcaaaggatataagtagatgttccaacaagtgagcaattcccaagatttcatctatatcattctcgaatccgaaattagaaattcccaagtagatatcctttttcatccgatcgttgatgaaaatacgaactttattcggtaagacaatcatttactaaggagtaaaataggaagtaatgttcgtatgtcgttatcatcgtataaattaaaggtgtgttttttaccattaagtgacattataattttaccaatattggaattataatataggtgtatttgcgcactcgcgacggttgatgcatcggtaaatatagctgtatctaatgttctagtcggtatttcatcatttcgctgtctaataatagcgttttctctatctgtttccattacagctgcctgaagtttattggtcggataatatgtaaaataataagaaatacatacgaataacaaaaataaaataagatataataaagatgccatttagagatctaattttgtttaacttgtccaaattcctacttacagaagatgaggaatcgttggagatagtgtcttccttatgtagaggatttgaaatatcttatgatgacttgataacttactttccagataggaaataccataaatatatttctaaagtatttgaacatgtagatttatcggaggaattaagtatggaattccatgatacaactctgagagatttagtctatcttagattgtacaagtattccaagtgtatacggccgtgttataaattaggagataatctaaaaggcatagttgttataaaggacaggaatatttatattagagaagcaaatgatgacttgatagaatatctcctcaaggaatacactcctcagatttatacatattctaatgagcgcgtccccataactggttcaaaattaattctttgtggattttctcaagttacatttatggcgtatacaacgtcgcatataacaacaaataaaaaggtagatgttctcgtttccaaaaaatgtatagatgaactagtcgatccaataaattatcaaatacttcaaaatttatttgataaaggaagcggaacaataaacaaaatactcaggaagatattttattcggtaaccggtggccaaactccataatttgctttttctatttcggattttagaatttccaaattcaccagcgatttatcggttttggtgaaatccaaggatttattaatgtccacaaatgccatttgttttgtctgtggattgtatttgaaaatggaaacgatgtagttagatagatgcgctgcaaagtttcctattagggttccgcgctttacgtcacccagcatacttgaatcaccatcctttaaaaaaaatgataagatatcaacatggagtatatcatactcggattttaattcttctactgcatcactgacattttcacaaatactacaatacggtttaccgaaaataatcagtacgttcttcatttatgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctactgataatcatcctaagatgataaaaaacttaactcaactgtttaaatttgttccctcggcagaggataactatttagcaaaattaacggcgttagtgaatggatgtgatttctttcctggactctatggggcatctataacacccaccaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatgttcctccttgtcaatgcactgttcaagaatttatattttccgcattagatgaaaaatggaacaattttaaatcatcttatttagagaccgttccgttaccctgccaattaatgtatgcattagaaccacgcaaggagattgatgtttcagaagttaaaactttatcatcttatatagatttcgaaaatactaaatcagatatcgatgttataaaatctatatcttcgatcttcggatattctaacgaaaactgtaacactatagtgttcggcatctataaggataatttactactgagtataaatagttcattttactttaacgatagtctgttaataaccaatactaaaagtgataatataataaatataggttactagattaaaaatggtgttccaactcgtgtgctctacgtgcggcaaagatatttctcacgaacgatataaattgattatacgaaaaaaatcattaaaggatgtactcgtcagtgtaaagaacgaatgttgtaggttaaaattatctacacaaatagaacctcaacgtaacttaacagtgcaacctctattggatataaactaatatggatccggttaattttatcaagacatatgcgcctagaggttctattatttttattaattataccatgtcattaacaagtcatttgaatccatcgatagaaaaacatgtgggtatttattatggtacgttattatcggaacacttggtagttgaatctacctatagaaaaggagttcgaatagtcccattggatagtttttttgaaggatatcttagtgcaaaagtatacatgttagagaatattcaagttatgaaaatagcagctgatacgtcattaactttattgggtattccgtatggatttggtcatgatagaatgtattgttttaaattggtagctgaatgttataaaaatgccggtattgatacatcgtctaaacgaatattaggtaaagatatttttctgagccaaaacttcacagatgataatagatggataaagatatatgattctaataatttaacattttggcaaattgattaccttaaagggtgagttaatatgcataactactcctccgttgttttttccctcgttctttttcttaacgttgtttgccatcactctcataatgtaaagatattctaaaatggtaaacttttgcatatcggacgcagaaattggtataaatgttgtaattgtattatttcccgtcaatggactagtcacagctccatcagttttatatcctttagagtatttctcactcgtgtctaacattctagagcattccatgatctgtttatcgttgatattggccggaaagatagattttttattttttattatattactattggcaattgtagatataacttctggtaaatatttttctaccttttcaatctcttctattttcaagccggctatatattctgctatattgttgctagtatcaataccttttctggctaagaagtcatatgtggtattcactatatcagttttaactggtagttccattagcctttccacttctgcagaataatcagaaattggttctttaccagaaaatccagctactataataggctcaccgatgatcattggcaaaatcctatattgtaccagattaatgagagcatatttcatttccaataattctgctagttcttgagacattgatttatttgatgaatctagttggttctctagatactctaccatttctgccgcatacaataacttgttagataaaatcagggttatcaaagtgtttagcgtggctagaatagtgggcttgcatgtattaaagaatgcggtagtatgagtaaaccgttttaacgaattatatagtctccagaaatctgtggcgttacatacatgagccgaatgacatcgaagattgtccaatatttttaatagctgctctttgtccattatttctatatttgactcgcaacaattgtagataccattaatcactgattcctttttcgatgccggacaatagcacaattgtttagctttggactctatgtattcagaattaatagatatatctctcaatacagattgcactatacattttgaaactatgtcaaaaattgtagaacgacgctgttctgcagccatttaactttaaataatttacaaaaatttaaaatgagcatccgtataaaaatcgataaactgcgccaaattgtggcatatttttcagagttcagtgaagaagtatctataaatgtagactcgacggatgagttaatgtatatttttgccgccttgggcggatctgtaaacatttgggccattatacctctcagtgcatcagtgttctaccgcggagccgaaaacattgtgtttaatcttcctgtgtccaaggtaaaatcgtgtttgtgtagttttcacaatgatgccatcatagatatagaacctgatctggaaaataatctagtaaaactttctagttatcatgtagtaagtgtcgattgtaacaaggaactgatgcctattaggacagatactactatttgtctaagtatagatcaaaagaaatcttacgtgtttaattttcacaagtatgaagaaaaatgttgtggtagaaccgtcattcatttagaatggttgttgggctttatcaagtgtattagtcagcatcagcatttggctattatgtttaaagatgacaatattattatgaagactcctggtaatactgatgcgttttccagggaatattctatgactgaatgttctcaagaactacaaaagttttctttcaaaatagctatctcgtctctcaacaaactacgaggattcaaaaagagagtcaatgtttttgaaactagaatcgtaatggataatgacgataacattctaggaatgttgttttcggatagagttcaatcctttaagatcaacatctttatgacgtttttagattaatactttcaatgagataaatatgggtggcagagtaagtgttgagctccctaaacgggatccgcctccgggagtacccactgatgagatgttattaaacgtggataaaatgcatgacgtgatagctcccgctaagcttttagaatatgtgcatataggaccactagcaaaagataaagaggataaagtaaagaaaagatatccagagtttagattagtcaacacaggacccggtggtctttcggcattgttaagacaatcgtataatggaaccgcacccaattgctgtcgcacttttaatcgtactcattattggaaaaaggatggaaagatatcagataagtatgaagagggtgcagtattagaatcgtgttggccagacgttcacgacactggaaaatgcgatgttgatttattcgactggtgtcagggggatacgttcgatagaaacatatgccatcagtggatcggttcagcctttaataggagtgatagaactgtagagggtcaacaatcgttaataaatctgtataataagatgcaaacattatgtagtaaagatgctagtgtaccaatatgtgaatcatttttgcatcatttacgcgcacacaatacagaagatagcaaagagatgatcgattatattctaagacaacagtctgcggactttaaacagaaatatatgagatgtagttatcccactagagataagttagaagagtcattaaaatatgcggaacctcgagaatgttgggatccagagtgttcgaatgccaatgttaatttcttactaacacgtaattataataatttaggactttgcaatattgtacgatgtaatactagcgtgaacaacttacagatggataaaacttcctcattaagattgtcatgtggattaagcaatagtgatagattttctactgttcccgtcaatagagcaaaagtagttcaacataatattaaacattcgttcgacctaaaattgcatttgatcagtttattatctctcttggtaatatggatactaattgtagctatttaaatgggtgccgcggcaagcatacagacgacggtgaatacactcagcgaacgtatctcgtctaaattagaacaagaagcgaacgctagtgctcaaacaaaatgtgatatagaaatcggaaatttttatatccgacaaaaccatggatgtaacctcactgttaaaaatatgtgctctgcggacgcggatgctcagttggatgctgtgttatcagccgctacagaaacatatagtggattaacaccggaacaaaaagcatacgtaccagctatgtttactgctgcgttaaacattcagacgagtgtaaacactgttgttagagattttgaaaattatgtgaaacagacttgtaattctagcgcggtcgtcgataacaaattaaagatacaaaacgtaatcatagatgaatgttacggagccccaggatctccaacaaatttggaatttattaatacaggatctagcaaaggaaattgtgccattaaagcgttgatgcaattgacgactaaggccactactcaaatagcacctagacaagttgctggtacaggagttcagttttatatgattgttatcggtgttataatattggcagcgttgtttatgtactatgccaagcgtatgttgttcacatccaccaatgataaaatcaaacttattttagccaataaggaaaacgtccattggactacttacatggacacattctttagaacttctccgatggttattgctaccacggatatgcaaaactgaaaatatattgataatattttaatagattaacatggaagttatcgctgatcgtctagacgatatagtgaaacaaaatatagcggatgaaaaatttgtagattttgttatacacggtctagagcatcaatgtcctgctatacttcgaccattaattaggttgtttattgatatactattatttgttatagtaatttatatttttacggtacgtctagtaagtagaaattatcaaatgttgttggcgttggtggcgctagtcatcacattaactattttttattactttatactataatagtactagactgacttctaacaaacatctcacctgccataaataaatgcttgatattaaagtcttctatttctaacactattccatctgtggaaaataatactctgacattatcgctaattgacacatcggtgagtgatatgcctataaagtaataatcttctttgggcacatataccagtgtaccaggttctaacaacctatttactggtgctcctgtagcatactttttctttaccttgagaatatccatcgtttgcttggtcaatagcgatatgtgattttttatcaaccactcaaaaaagtaattggagtgttcatatcctctacgggctattgtctcatggccgtgtatgaaatttaagtaacacgactgtggtagatttgttctatagagccggttgccgcaaatagatagaactaccaatatgtctgtacaaatgttaaacattaattgattaacagaaaaaacaatgttcgttctgggaatagaaaccagatcaaaacaaaattcgttagaatatatgccacgtttatacatggaatataaaataactacagtttgaaaaataacagtatcatttaaacatttaacttgcggggttaatttcacaactttactgtttttaaactgttcaaaatatagcatcgatccatgagaaatacgtttagccgcctttaatagaggaaatcccaccgcctttctggatctcaccaacgacgatagttctgaccagcaacttatttcttcatcatccacctgttttaacatataataggcaggagatagatatccgtcattgcaatattccttttcgtaggcacacaatctaatattgataaaatctccattctcttctctgcatttattatcttgtttcggtggctgattaggctgtagtcttggtttaggctttggtatatcgttgttgaatctattttggtcattaaatctttcatttcttcctggtatatttttatcacctcgtttggttggatttttgtctatattatcgtttgtaacatcggtacgggtattcatttatcacaaaaaaaacttctctaaatgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgagaatatcacaggggcaatgtttaccacaatgtataatataagaaacaatttgggtctaggagatgataaactaactattgaagccattgaaaactatttcttggatcctaacaatgaggttatgcctcttatcattaataatacggatatgactgccgtcattcctaaaaaaagtggtaggagaaagaataagaacatggttattttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatgtcctgaatgtgtattctccttccacatccatgagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattgattactataaatggagaatgttcctaatgtatactttaatcctgtgtttatagagcccacgtttaaacattctttattaagtgtttataaacacagattaatagttttatttgaagtattcattgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatgatgattcattttttaagtatttggctagtcaagatgatgaatcttcattatctgatatattgcaaatcactcaatatctagactttctgttattattattgatccaatcaaaaaataaattagaagccgtgggtcattgttatgaatctctttcagaggaatacagacaattgacaaaattcacagactttcaagattttaaaaaactgtttaacaaggtccctattgttacagatggaagggtcaaacttaataaaggatatttgttcgactttgtgattagtttgatgcgattcaaaaaagaatcctctctagctaccaccgcaatagatcctattagatacatagatcctcgtcgcgatatcgcattttctaacgtgatggatatattaaagtcgaataaagtgaacaataattaattctttattgtcatcatgaacggcggacatattcagttgataatcggccccatgttttcaggtaaaagtacagaattaattagacgagttagacgttatcaaatagctcaatataaatgcgtgactataaaatattctaacgataatagatacggaacgggactatggacgcatgataagaataattttgaagcattggaagcaactaaactatgtgatgtcttggaatcaattacagatttctccgtgataggtatcgatgaaggacagttctttccagacattgttgaattctgtgagcgtatggcaaacgaaggaaaaatagttatagtagccgcactcgatgggacatttcaacgtaaaccgtttaataatattttgaatcttattccattatctgaaatggtggtaaaactaactgctgtgtgtatgaaatgctttaaggaggcttccttttctaaacgattgggtgaggaaaccgagatagagataataggaggtaatgatatgtatcaatcggtgtgtagaaagtgttacgtcggctcataatattatattttttatctaaaaaactaaaaataaacattgattaaattttaatataatacttaaaaatggatgttgtgtcgttagataaaccgtttatgtattttgaggaaattgataatgagttagattacgaaccagaaagtgcaaatgaggtcgcaaaaaaactgccgtatcaaggacagttaaaactattactaggagaattattttttcttagtaagttacagcgacacggtatattagatggtgccaccgtagtgtatataggatctgctcccggtacacatatacgttatttgagagatcatttctataatttaggagtgatcatcaaatggatgctaattgacggccgccatcatgatcctattttaaatggattgcgtgatgtgactctagtgactcggttcgttgatgaggaatatctacgatccatcaaaaaacaactgcatccttctaagattattttaatttctgatgtgagatccaaacgaggaggaaatgaacctagtacggcggatttactaagtaattacgctctacaaaatgtcatgattagtattttaaaccccgtggcgtctagtcttaaatggagatgcccgtttccagatcaatggatcaaggacttttatatcccacacggtaataaaatgttacaaccttttgctccttcatattcagctgaaatgagattattaagtatttataccggtgagaacatgagactgactcgagttaccaaatcagacgctgtaaattatgaaaaaaagatgtactaccttaataagatcgtccgtaacaaagtagttgttaactttgattatcctaatcaggaatatgactattttcacatgtactttatgctgaggaccgtgtactgcaataaaacatttcctactactaaagcaaaggtactatttctacaacaatctatatttcgtttcttaaatattccaacaacatcaactgaaaaagttagtcatgaaccaatacaacgtaaaatatctagcaaaaattctatgtctaaaaacagaaatagcaagagatccgtacgcagtaataaatagaaacgtactactgagatatactaccgatatagagtataatgatttagttactttaataaccgttagacataaaattgattctatgaaaactgtgtttcaggtatttaacgaatcatccataaattatactccggttgatgatgattatggagaaccaatcattataacatcgtatcttcaaaaaggtcataacaagtttcctgtaaattttctatacatagatgtggtaatatctgacttatttcctagctttgttagactagatactacagaaactaatatagttaatagtgtactacaaacaggcgatggtaaaaagactcttcgtcttcccaaaatgttagagacggaaatagttgtcaagattctctaccgtcctaatataccattaaaaattgttagatttttccgcaataacatggtaactggagtagagatagccgatagatctgttatttcagtcgctgattaatcaattagtagagatgagataagaacattataataatcaataatatattttatatcttatatcttgtttagaaaaatgctaatattaaaatagctaacgctagtaatccaatcggaagccatttgatatctataatagggtatctaatttcctgattcagatagcggacagctatattctcggtagctactcgtttggaatcacaaacattatttacatctaatttactatctgtaatggaaacgtttcccaatgaaatggtacaatccgatacattgcattttgttatatttttttttaaagaggctggtaacaacgcatcgcttcgtttacatggctcgtaccaacaataatagggtaatcttgtatctattcctatccgtactatgcttttatcaggataaatacatttacatcgtatatcgtctttgttagcatcacagaatgcataaatttgttcgtccgtcatgataaaaatttaaagtgtaaatataactattattttatagttgtaataaaaagggaaatttgattgtatactttcggttctttaaaagaaactgacttgataaaaatggctgtaatctctaaggttacgtatagtctatatgatcaaaaagagattaatgctacagatattatcattagtcatgttaaaaatgacgacgatatcggtaccgttaaagatggtagactaggtgctatggatggggcattatgtaaaacttgtgggaaaacggaattggaatgtttcggtcactggggtaaagtaagtatttataaaactcatatagttaagcctgaatttatttcagaaattattcgtttactgaattatatatgtattcactgcggattattgcgttcacgagaaccgtattccgacgatattaacctaaaagagttatcgggacacgctcttaggagattaaaggataaaatattatccaagaaaaagtcatgttggaacagtgaatgtatgcaaccgtatcaaaaaattactttttcaaagaaaaaggtttgtttcgtcaacaagttggatgatattaacgttcctaattctctcatctatcaaaagttaatttctattcatgaaaagttttggccattattagaaattcatcaatatccagctaacttattttatacagactactttcccatccctccgttgattattagaccggctattagtttttggatagatagtatacccaaagaaaccaatgaattaacttacttattaggtatgatcgttaagaattgtaacttgaatgctgatgaacaggttatccagaaggcggtaatagaatacgatgatattaaaattatttctaataacacttccagtatcaatttatcatatatcacatccggcaaaaataatatgattagaagttatatcgtcgcccggcgaaaagatcagaccgctagatctgtaattggtcccagtacatctatcaccgttaatgaggtaggaatgcccgcatatattagaaatacacttacagaaaagatatttgttaatgcctttacagtggataaagttaaacaactattagcgtcaaaccaagttaaattttactttaataaacgattaaaccaattaacaagaatacgccaaggaaagtttatcaaaaataaaatacatttattgcctggtgattgggtagaagtagctgttcaagaatatacaagtattatttttggaagacagccgtctctacatagatacaacgtcatcgcttcatctatcagagctaccgaaggagatactatcaaaatatctcccggaattgtcaactctcaaaatgctgatttcgacggagatgaagaatggatgatattggagcaaaatcctaaagccgtaattgaacaaagtattcttatgtatccgacgacgttactcaaacacgatattcatggagcccccgtttatggatctattcaagatgaaatcgtagcagcgtattcattgtttaggatacaagatctttgtttagatgaagtattgaacatcttggggaaatatggaagagagttcgatcctaaaggtaaatgtaaattcagcggtaaagatatctatacttacttgataggtgaaaagattaattatccgggtctcttaaaggatggtgaaattattgcaaacgacgtagatagtaattttgttgtggctatgaggcatctgtcattggctggactcttatccgatcataagtcgaacgtggaaggtatcaactttattatcaagtcatcttatgtttttaagagatatctatctatttacggttttggggtgacattcaaagatctgagaccaaattcgacgttcactaataaattggaggccatcaacgtagaaaaaatagaacttatcaaagaagcatacgccaaatatctcaacgatgtaagagacgggaaaatagttccattatctaaagctttagaggcggactatgtggaatccatgttatccaacttgacaaatcttaatatccgagagatagaagaacatatgagacaaacgctgatagatgatccagataataacctcctgaaaatggccaaagcgggttataaagtaaatcccacagaactaatgtatattctaggtacttatggacaacagaggattgatggtgaaccagcagagactcgagtattgggtagagtcttaccttactatcttccagactctaaggatccagaaggaagaggttacattcttaattctttaacaaaaggattaacgggttctcaatattacttttcgatgctggttgcaagatctcaatctactgatatcgtctgtgaaacatcacgtaccggaacactggctagaaaaatcattaaaaagatggaggatatggtggtcgacggatacggacaagtagttataggtaatacgctcatcaagtacgccgccaattataccaaaattctaggctcagtatgtaaacctgtagatcttatctatccagatgagtccatgacttggtatttggaaattagtgctctgtggaataaaataaaacagggattcgtttactctcagaaacagaaacttgcaaaaaagacattggcgccgtttaatttcctagtattcgtcaaacccaccactgaggataatgctattaaggttaaggatctgtacgatatgattcataacgtcattgatgatgtgagagagaaatacttctttacggtatctaatatagattttatggagtatatattcttgacgcatcttaatccttctagaattagaattacaaaagaaacggctatcactatctttgaaaagttctatgaaaaactcaattatactctaggtggtggaactcctattggaattatttctgcacaggtattgtctgagaagtttacacaacaagccctgtccagttttcacactactgaaaaaagtggtgccgtcaaacaaaaacttggtttcaacgagtttaataacttgactaatttgagtaagaataagaccgaaattatcactctggtatccgatgatatctctaaacttcaatctgttaagattaatttcgaatttgtatgtttgggagaattaaatccaaacatcactcttcgaaaagaaacagataggtatgtagtagatataatagtcaatagattatacatcaagagagcagaaattaccgaattagtcgtcgaatatatgattgaacgattcatctcctttagcgtcattgtaaaggaatggggtatggaaacattcattgaggatgaggataatattagatttactgtctacctaaatttcgttgaaccggaagaattgaatcttagtaagtttatgatggttcttccgggtgccgccaacaagggcaagattagtaaattcaagattcctatctctgattatacgggatatgacgacttcaatcaaacaaaaaagctcaataagatgactgtagaactcatgaatctaaaagaattgggttctttcgatttggaaaacgtcaacgtgtatcctggagtatggaatacatacgatatcttcggtatcgaggccgctcgtgaatacttgtgcgaagccatgttaaacacctatggagaagggttcgattatctgtatcagccttgtgatcttctcgctagtttactatgtgctagttacgaaccagaatcagtgaataaattcaagttcggcgcagctagtactcttaagagagctacgttcggagacaataaagcattgttaaacgcggctcttcataaaaagtcagaacctattaacgataatagtagctgccacttttttagcaaggtccctaatataggaactggatattacaaatactttatcgacttgggtcttctcatgagaatggaaaggaaactatctgataagatatcttctcaaaagatcaaggaaatggaagaaacagaagacttttaattcttatcaataacatatttttctatgatctgtcttttaaacgatggattttccacaaatgcgcctctcaagtccctcatagaatgatacacgtataaaaaatatagcataggcaatgactccttatttttagacattagatatgccaaaatcatagccccgcttctatttactcccgcagcacaatgaaccaacacgggctcgtttcgttgatcacatttagataaaaaggcggttacgtcgtcaaaatatttactaatatcggtagttgtatcatctaccaacggtatatgaataatattaatattagagttaggtaatgtatatttatccatcgtcaaatttaaaacatatttgaacttaacttcagatgatggtgcatccatagcatttttataatttcccaaatacacattattggttactcttgtcattatagtgggagatttggctttgtgcatatctccagttgaacgtagtagtaagtatttatacaaacttttcttatccatttataacgtacaaatggataaaactactttatcggtaaacgcgtgtaatttagaatacgttagagaaaaggctatagtaggcgtacaagcagccaaaacatcaacacttatattctttgttattatattggcaattagtgcgctattactctggtttcagacgtctgataatccagtctttaatgaattaacgagatatatgcgaattaaaaatacggttaacgattggaaatcattaacggatagcaaaacaaaattagaaagtgatagaggtagacttctagccgctggtaaggatgatatattcgaattcaaatgtgtggatttcggcgcctattttatagctatgcgattggataagaaaacatatctgccgcaagctattaggcgaggtactggagacgcgtggatggttaaaaaggcggcaaaggtcgatccatctgctcaacaattttgtcagtatttgataaaacacaagtctaataatgttattacttgtggtaatgagatgttaaatgaattaggttatagcggttattttatgtcaccgcattggtgttccgattttagtaatatggaatagtgttagataaatgcggtaacgaatgttcctgtaaggaaccataacagcttagatttaacgttaaagatgagcataaacataataaacaaaattacaatcaaacctataacattaatatcaaacaatccaaaaaatgaaatcagtggagtagtaaacgcgtacataactcctggataacgtttagcagctgccgttcctattctagaccaaaaattcggtttcatgttttcgaaacggtattctgcaacaagtcgaggatcgtgttctacatatttggcggcgttatccagtatctgcctattgatcttcatttcgttttcgattctggctatttcaaaataaaatcccgatgatagacctccagactttataatttcatctacgatgttcagcgccgtagtaactctaataatataggctgataagctaacatcataccctcctgtatatgtgaatatggcatgatttttgtccattacaagctcggttttaactttattgcctgtaataatttctctcatctgtaggatatctatttttttgtcatgcattgccttcaagacgggacgaagaaacgtaatatcctcaataacgttatcgttttctacaataactacatattctacctttttattttctaactcggtaaaaaaattagaatcccatagggctaaatgtctagcgatatttcttttcgtttcctctgtacacatagtgttacaaaaccctgaaaagaagtgagtatacttgtcatcatttctaatgtttcctccagtccactgtataaacgcataatccttgtaatgatctggatcatccttgactaccacaacatttcttttttctggcataacttcattgtcctttacatcatcgaacttctgatcattaatatgctcatgaacattaggaaatgtttctgatggaggtctatcaataactggcacaacaataacaggagttttcaccgccgccatttagttattgaaattaatcatatacaactctttaatacgagttatattttcgtctatccattgtttcacatttacatatttcgacaaaaagatataaaatgcgtattccaatgcttctctgtttaatgaattactaaaatatacaaacacgtcactgtctggcaataaatgatatcttagaatattgtaacaatttattttgtattgcacatgttcgtgatctatgagttcttcttcgaatggcataggatctccgaatctgaaaacgtataaataggagttagaataataatatttgagagtattggtaatatataaactctttagcggtataattagtttttttctctcgatttctatttttagatgtgatggaaaaatgactaattttgtagcattagtatcatgaactctaatcgagatcttaatatcttcgtcacacgttagttctttgaagtttttaagagatgcatcagttggttcgaccgatggagtaggtgcaacaattttttgttcgatgtatgtatgtactggagccattgtcttaactataatggtgcttgtatcgaaaaactttaatgcagataatggaagctcttcgccgcgactttctacatcgtaattgggttctaacgccgatctctgaatggatactagttttctaagttctaatgtgattctctgaaaatgtaaatccaattcctccggcattatagatgtgtatacatcggtaaataaaactatagtatccaacgatcccttctcgcaaattctagtcttaaccaaaaaatcgtatataaccacggagatggcgtatttaagagtggattcttctaccgttttgttcttggatttcatataagaaactataaagtccgcactactgttaagaatgattactaacgcaactatatagtttaaattaagcatcttggaaacataaaataactctgtagacgatacttgactttcgaataagtttgcagacaaacgaagaaagaacagacctctcttaatttcagaagaaaactttttttcgtattcctgacgtctagagtttatatcaataagaaagttaagaattagtcggttaatgttgtatttcattacccaagtttgagatttcataatattatcaaaagacatgataatattaaagataaagcgctgactatgaacgaaatagctatatggttcgctcaagaatatagtcttgttaaacgtggaaacgataactgtatttttaatcacgtcagcggcatctaaattaaatataggtatatttattccacacactctacaatatgccacaccatcttcataataaataaattcgttagcaaaattattaattttagtgaaatagttagcgtcaactttcatagcttccttcaatctaatttgatgctcacacggtgcgaattccactctaacatcccttttccatgcctcaggttcatcgatctctataatatctagttttttgcgtttcacaaacacaggctcgtctctcgcgatgagatctgtatagtaactatgtaaatgataactagatagaaagatgtagctatatagatgacgatcctttaagagaggtatgatgactttaccccaatcagatagactgttgttatggtcttcggaaaaagaatttttataaatttttccagtattttccaaatatacgtacttaacatctaaaaaatccttaatgataataggaatggataatccgtctattttataaagaaatacatatcgcacattatacttttttttggaaatgggaataccgatgtgtctacataaatatgcaaagtctaaatattttttagagaatcttagttggtccaaattcttttccaagtacggtaatagatttttcatattgaacggtatcttcttaatctctggttctagttccgcattaaatgatgaaactaagtcactatttttataactaacgattacatcacctctaacatcatcatttaccagaatactgatcttcttttgtcgtaaatacatgtctaatgtgttaaaaaaaagatcatacaagttatacgtcatttcatctgtggtattcttgtcattgaaggataaactcgtactaatctcttctttaacagcctgttcaaatttatatcctatatacgaaaaaatagcaaccagtgtttgatcatccgcgtcaatattctgttctatcgtagtgtataacaatcgtatatcttcttctgtgatagtcgatacgttataaaggttgataacgaaaatatttttatttcgtgagataaagtcatcgtaggattttggacttatattcgcgtctagtagatatgcttttatttttggaatgatctcaattagaatagtctctttagagtccatttaaagttacaaacaactaggaaattggtttatgatgtataatttttttagtttttatagattctttattctatacttaaaaaatgaaaataaatacaaaggttcttgagggttgtgttaaattgaaagcgagaaataatcataaattatttcattatcgcgatatccgttaagtttgtatcgtaatggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggctgctgtagagctcgatgatagcgacggggatgatgaacctatggtacaagttgaagctggtaaagtaaatcatagtgctagaagcgatctttctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaaatgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataaaccgctattgaaactgacggatgattctagtcccgaagaatttctgttcaacaaactaagtgaacgaaaggtatacgaatgtatcaaacagtttggtattagaatcaaggatctccgaacgtatggagtcaattatacgtttttatataatttttggacaaatgtaaagtccatatctcctcttccgtcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatgatatagatctttacacaaataattacaagaccgataaatggaaatggataagcgtatgaaatctctcgcaatgacagctttcttcggagagctaaacacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgtatcagtcgagatacagaaaagcttaaaatagctctagctaaaggcatagattacgaatatataaaagacgcttgttaataagtaaatgaaaaaaaactagtcgtttataataaaacacaatatggatgccaacatagtatcatcttctactattgcaacgtatatagacgctttagcgaagaatgcttcagaattagaacagaggtctaccgcatacgaaataaataatgaattggaactagtatttattaagccgccattaattactttgacaaatgtagtgaatatctctacgattcaggaatcgtttattcgatttaccgttactaataaggaaggtgttaaaattagaactaagattccattatctaaggtacatggtctagatgtaaaaaatgtacagttagtagatgctatagataacatagtttgggaaaagaaatcattagtgacggaaaatcgtcttcacaaagaatgcttgttgagactatcgacagaggaacgtcatatatttttggattacaagaaatatggatcctctatccgactagaattagtcaatcttattcaagcaaaaacaaaaaactttacgatagactttaagctaaaatattttctaggatccggtgcccagtctaaaagttctttattacacgctattaatcatccaaagtcaaggcctaatacatctctggaaatagaattcacacctagagacaatgaaaaagttccatatgatgaactaataaaggaattgacgactctatcacgtcatatatttatggcttctccagagaatgtaattctttctccgcctattaacgcgcctataaaaacctttatgttgcctaaacaagatatagtaggtttggatctggaaaatctatatgccgtaactaagactgacggaattcctataactatcagagttacatcaaaagggttgtattgttattttacacatcttggttatattattagatatcctgttaagagaataatagattccgaagtagtagtctttggtgaggcagttaaggataagaactggaccgtatatctcattaagctaatagagcctgtgaatgcaatcaatgatagactagaagaaagtaagtatgttgaatctaaactagtggatatttgtgatcggatagtattcaagtcaaagaaatacgaaggtccgtttactacaactagtgaagtcgtcgatatgttatctacatatttaccaaagcaaccagaaggtgttattctgttctattcaaagggacctaaatctaacattgattttaaaattaaaaaggaaaatactatagaccaaactgcaaatgtagtatttaggtacatgtccagtgaaccaattatctttggagaatcgtctatctttgtagagtataagaaatttagcaacgataaaggctttcctaaagaatatggttctggtaagattgtgttatataacggcgttaattatctaaataatatctattgtttggaatatattaatacacataatgaagtgggtattaagtccgtggttgtacctattaagtttatagcagaattcttagttaatggagaaatacttaaacctagaattgataaaaccatgaaatatattaactcagaagattattatggaaatcaacataatatcatagtcgaacatttaagagatcaaagcatcaaaataggagatatctttaacgaggataaactatcggatgtgggacatcaatacgccaataatgataaatttagattaaatccagaagttagttattttacgaataaacgaactagaggaccgttgggaattttatcaaactacgtcaagactcttcttatttctatgtattgttccaaaacatttttagacgattccaacaaacgaaaggtattggcgattgattttggaaacggtgcggacctggaaaaatacttttatggagagattgcgttattggtagcgacggatccggatgctgatgctatagctagaggaaatgaaagatacaacaaattaaactctggaattaaaaccaagtactacaaatttgactacattcaggaaactattcgatccgatacatttgtctctagtgtcagagaagtattctattttggaaagtttaatatcatcgactggcagtttgctatccattattcttttcatccgagacattatgctaccgtcatgaataacttatccgaactaactgcttctggaggcaaggtattaatcactaccatggacggagacaaattatcaaaattaacagataaaaagacttttataattcataagaatttacctagtagcgaaaactatatgtctgtagaaaaaatagctgatgatagaatagtggtatataatccatcaacaatgtctactccaatgactgaatacattatcaaaaagaacgatatagtcagagtgtttaacgaatacggatttgttcttgtagataacgttgatttcgctacaattatagaacgaagtaaaaagtttattaatggcgcatctacaatggaagatagaccgtctacaaaaaactttttcgaactaaatagaggagccattaaatgtgaaggtttagatgtcgaagacttacttagttactatgttgtttatgtcttttctaagcggtaaataataatatggtatgggttctgatatccccgttctaaatgcattaaataattccaatagagcgatttttgttcctataggaccttccaactgtggatactctgtattgttaatagatatattaatacttttgtcgggtaacagaggttctacgtcttctaaaaataaaagtttgataacatctggcctgttcataaataaaaacttggcgattctatatatactcttattatcaaatctagccattgtcttatagatgtgagctactgtaggtgtaccatttgattttctttctaatactatatatttctctcgaagaagttcttgcacatcatctgggaataaaatactactgttgagtaaatcagttattttttttatatcgatattgatggacatttttatagttaaggataataagtatcccaaagtcgataacgacgataacgaagtatttatacttttaggaaatcacaatgactttatcagatcaaaattaacaaaattaaaggagcatgtatttttttctgaatatattgtgactccagatacatatggatctttatgcgtcgaattaaatgggtctagttttcagcacggtggtagatatatagaggtggaggaatttatagatgctggaagacaagttagatggtgttctacatccaatcatatatctgaagatatgcacactgataaatttgtcatttatgatatttatacgtttgattcgttcaagaataaacgattggtatttgtacaggtgcctccatcattaggagatgatagctatttgactaatccgttattgtctccgtattatcgtaattcagtagccagacaaatggtcaatgatatgatttttaatcaagattcatttttaaaatatttattagaacatctgattagaagccactatagagtttctaaacatataacaatagttagatacaaggataccgaagaattaaatctaacgagaatatgttataatagagataagtttaaggcgtttgtattcgcttggtttaacggcgtttcggaaaatgaaaaggtactagatacgtataaaaaggtatctaatttgatataatgaattcagtgactgtatcacacgcgccatatactattacttatcacgatgattgggaaccagtaatgagtcaattggtagagttttataacgaagtagccagttggctgctacgagacgagacgtcgcctattcctgataagttctttatacagttgaaacaaccgcttagaaataaacgagtatgtgtgtgtggtatagatccgtatccgaaagatggaactggtgtaccgttcgaatcaccaaattttacaaaaaaatcaattaaggagatagcttcatctatatctagattaaccggagtaattgattataaaggttataaccttaatataatagacggggttataccctggaattattacttaagttgtaaattaggagaaacaaaaagtcacgcgatctactgggataagatttccaagttactgctgcagcatataactaaacacgttagtgttctttattgtttgggtaaaacagatttctcgaatatacgggcaaagttagaatccccggtaactaccatagtcggatatcatccagcggctagagaccgccaattcgagaaagatagatcatttgaaattatcaacgttttactggaattagacaacaaggcacctataaattgggctcaagggtttatttattaatgctttagtgaaattttaacttgtgttctaaatggatgcaactattagaggtaatgatgttatctttgttcttaagactataggtgtcccgtcagcgtgcagacaaaatgaagatccaagatttgtagaagcatttaaatgcgacgagttagaaagatatattgagaataatccagaatgtacactattcgaaagtcttagggatgaggaagcatactctatagtcagaattttcatggatgtagatttagacgcgtgtctagacgaaatagattatttaacggctattcaagattttattatcgaggtgtcaaactgtgtagctagattcgcgtttacagaatgcggtgccattcatgaaaatgtaataaaatccatgagatctaatttttcattgactaagtctacaaatagagataaaacaagttttcatattatctttttagacacgtataccactatggatacattgatagctatgaaacgaacactattagaattaagtagatcatctgaaaatccactaaccagatcgatagacactgccgtatataggagaaaaacaactcttcgggttgtaggtactaggaaaaatccaaattgcgacactattcatgtaatgcaaccaccgcatgataatatagaagattacctattcacttacgtggatatgaacaacaatagttattacttttctctacaacgacgattggaggatttagttcctgataagttatgggaaccagggtttatttcattcgaagacgctataaaaagagtttcaaaaatattcattaattctataataaactttaatgatctcgatgaaaataattttacaacggtaccactggtcatagattacgtaacaccttgtgcattatgtaaaaaacgatcgcataaacatccgcatcaactatcgttggaaaatggtgctattagaatttacaaaactggtaatccacatagttgtaaagttaaaattgttccgttggatggtaataaactgtttaatattgcacaaagaattttagacactaactctgttttattaaccgaacgaggagaccatatagtttggattaataattcatggaaatttaacagcgaagaacccttgataacaaaactaattctgtcaataagacatcaactacctaaggaatattcaagcgaattactctgtccgaggaaacgaaagactgtagaagctaacatacgagacatgttaatagattcagtggagaccgatacctatccggataaacttccgtttaaaaatggtgtattggacctggtagacggaatgttttactctggagatgatgctaaaaaatatacgtgtactgtatcaaccggatttaaatttgacgatacaaagttcgtcgaagacagtccagaaatggaagagttaatgaatatcattaacgatatccaaccattaacggatgaaaataagaaaaatagagagttgtacgaaaaaactttatctagttgtttatgcggtgctaccaaaggatgtttaacattcttttttggagaaactgcaactggaaagtcgacaaccaaacgtttgttaaagtctgctatcggtgacctgtttgttgagacgggtcaaacaattttaacagatgtattggataaaggacctaatccatttatcgctaacatgcatttgaaaagatctgtattctgtagcgaactacctgattttgcctgtagtggatcaaagaaaattagatctgacaatattaaaaagttgacagaaccttgtgtcattggaagaccgtgtttctccaataaaattaataatagaaaccatgcgacaatcattatcgatactaattacaaacctgtctttgataggatagataacgcattaatgagaagaattgccgtcgtgcgattcagaacacacttttctcaaccttctggtagagaggctgctgaaaataatgacgcgtacgataaagtcaaactattagacgaggggttagatggtaaaatacaaaataatagatatagattcgcatttctatacttgttggtgaaatggtacaaaaaatatcatgttcctattatgaaactatatcctacaccggaagagattccggactttgcattctatctcaaaataggtactctgttagtatctagctctgtaaagcatattccattaatgacggacctctccaaaaagggatatatattgtacgataatgtggttactcttccgttgactactttccaacagaaaatatccaagtattttaattctagactatttggacacgatatagagagcttcatcaatagacataagaaatttgccaatgttagtgatgaatatctgcaatatatattcatagaggatatttcatctccgtaaatatatgctcatatatttatagaagatatcacatatctaaatgaataccggaatcatagatttatttgataatcatgttgatagtataccaactatattacctcatcagttagctactctagattatctagttagaactatcatagatgagaacagaagcgtgttattgttccatattatgggatcaggtaaaacaataatcgctttgttgttcgccttggtagcttccagatttaaaaaggtttacattctagtgcctaatattaacattttgaaaatttttaattataatatgggtgtagctatgaacttgtttaatgacgaattcatagctgagaatatctttattcattccacaacaagtttttattctcttaattataacgataacgtcattaattataacggattatctcgctacaataactctatttttatcgttgatgaggcacataatatctttgggaataatactggagaacttatgaccgtgataaaaaataaaaacaagattccttttttactattgtctggatctcccattactaacacacctaatactctgggtcatattatagatttaatgtccgaagagacgatagattttggtgaaattattagtcgtggtaagaaagtaattcagacacttcttaacgaacgaggtgtgaatgtacttaaggatttgcttaaaggaagaatatcatattacgaaatgcctgataaagatctaccaacgataagatatcacggacgtaagtttctagatactagagtagtatattgtcacatgtctaaacttcaagagagagattatatgattactagacgacagctatgttatcatgaaatgtttgataaaaatatgtataacgtgtcaatggcagtattgggacaacttaatctgatgaataatttagatactttatttcaggaacaggataaggaattgtacccaaatctgaaaataaataatggcgtgttatacggagaagaattggtaacgttaaacattagttccaaatttaaatactttattaatcggatacagacactcaacggaaaacattttatatacttttctaattctacatatggcggattggtaattaaatatatcatgctcagtaatggatattctgaatataatggttctcagggaactaatccacatatgataaacggcaaaccaaaaacatttgctatcgttactagtaaaatgaaatcgtctttagaggatctattagatgtgtataattctcctgaaaacgatgatggcagtcaattgatgtttttgttttcgtcaaacattatgtccgaatcctatactctgaaagaggtaaggcatatttggtttatgactatcccagatactttttctcaatacaaccaaattcttggacgatctattagaaaattctcttacgccgatatttctgaaccagttaatgtatatcttttagccgccgtatattccgatttcaatgacgaagtgacgtcattaaacgattacacacaggatgaattaattaatgttttaccatttgacatcaaaaagctgttgtatctaaaatttaagactaaagaaacgaatagaatatactctattcttcaagagatgtctgaaacgtattctcttccaccacatccatcaattgtaaaagttttattgggagaattggtcagacaatttttttataataattctcgtattaagtataacgataccaagttacttaaaatggttacatcagttataaaaaataaagaagacgctaggaattacatagatgatattgtaaacggtcacttctttgtatcgaataaagtatttgataaatctcttttatacaaatacgaaaacgatattattacagtaccgtttagactttcctacgaaccatttgtttggggagttaactttcgtaaagaatataacgtggtatcttctccataaaactgatgagatatataaagaaataaatgtcgagctttgttaccaatggataccttccagttacattggagccacacgagctgacgttagacataaaaactaatattaggaatgccgtatataagacgtatctccatagagaaattagtggtaaaatggccaagaaaatagaaattcgtgaagacgtggaattacctctcggcgaaatagttaataattctgtagttataaacgttccgtgtgtaataacctacgcgtattatcacgttggggatatagtcagaggaacattaaacatcgaagatgaatcaaatgtaactattcaatgtggagatttaatctgtaaactaagtagagattcgggtactgtatcatttagcgattcaaagtactgcttttttcgaaatggtaatgcgtatgacaatggcagcgaagtcactgccgttctaatggaggctcaacaaggtatcgaatctagttttgtttttctcgcgaatatcgttgactcataaaaaagagaatagcggtaagtataaacacgaatactatggcaataattgcgaatgttttattcccttcgatatatttttgataatatgaaaaacatgtctctctcaaatcggacaaccatctcataaaatagttctcgcgcgctggagaggtagttgctgctcgtataatctccccagaataatatacttgcgtgtcgtcgttcaatttatacggatttctatagttctctgttatataatgcggttttccatcatgattagacgacgacaatagtgttctaaatttagatagttgatcagaatgaatgtttattggcgttggaaaaattatccatacagcgtctgcagagtggttgatagttgttcctagatatgtaaaataatccaacttactaggcagcaaattgtctagataaaatactgaatcaaacggtgcagacgtattggtggatctaatggaatccaattgattaactatcttttgaaaatatacatttttatgatccgatacttgtaagaatatagaaataatgataagtccatcatcgtgtttttttgcctcttcataagaactatattttttcttattccaatgaacaagattaatctctccagagtatttgtacacatctatcaagtgattggatccataatcgtcttcctttccccaatatatacgtagtgatgataacacatattcattggggagaaaccctccacttatatatcctcctttaaaattaatccttactagttttccagtgttctggatagtggttggtttcgactcattataatgtatgtctaacggcttcaatcgcgcgttagaaattgcttttttagtttctatattaataggagatagttgttgcggcatagtaaaaatgaaatgataactgtttaaaaatagctcttagtatgggaattacaatggatgaggaagtgatatttgaaactcctagagaattaatatctattaaacgaataaaagatattccaagatcaaaagacacgcatgtgtttgctgcgtgtataacaagtgacggatatccgttaataggagctagaagaacttcattcgcattccaagcgatattatctcaacaaaattcagattctatctttagagtatccactaaactattacggtttatgtactacaatgaactaagagaaatctttagacggttgagaaaaggttctatcaacgatatcgatcctcactttgaagagttaatattattgggtggtaaactagataaaaaggaatctattaaagattgtttaagaagagaattaaaagaggaaagtgatgaacgtataacagtaaaagaatttggaaatgtaattctaaaacttacaacacgggataaattatttaataaagtatatataagttattgcatggcgtgttttattaatcaatcgttggaggatttatcgcatactagtatttacaatgtagaaattagaaagattaaatcattaaatgattgtattaacgacgataaatacgaatatctgtcttatatttataatatgctagttaatagtaaatgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtctagaaagaaacgattatttctgaattattccaattatttgtccaaacaggaaagaagtatactatcgtcatttttttctctagatccagctactactgataatgatagaatagatgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctttaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattgattagaaaatataaattaatttaccatcgtgtatttttataacgggattgtccggcatatcatgtagatagttaccgtctacatcgtatactcgaccatctacgcctttaaatcctctatttattgacattaatctattagaattggaataccaaatattagtaccctcaattagtttattggtaatattttttttagacgatagatcgatggctcttgaaaccaaggttttccaaccggactcattgtcgatcggtgagaagtctttttcattagcatgaatccattctaatgatgtatgtttaaacactctaaacaattggacaaattcttttgatttgctttgaatgatttcaaataggtcttcgtctacagtaggcataccattagataatctagccattataaagtgcacgtttacatatctacgttctggaggagtaagaacgtgactattgagacgaatggctcttcctactatctgacgaagagacgcctcgttccatgtcatatctaaaatgaagatatcattaattgagaaaaaactaataccctcgcctccactagaagagaatacgcatgttttaatgcattctccgttagtgtttgattcttggttaaactcagccaccgccttgattctagtatcttttgttctagatgagaactctatattagagataccaaagactttgaaatatagtaataagatttctattcctgactgattaacaaatggttcaaagactagacatttaccatgggatgctaatattcccaaacatacatctataaatttgacgcttttctcttttaattcagtaaatagagagatatcagccgcactagcatcccctttcaatagttctccctttttaaaggtatctaatgcggatttagaaaactctctatctcttaatgaatttttaaaatcattatatagtgttgctatctcttgcgcgtattcgcccggatcacgattttgtctttcaggaaagctatcgaacgtaaacgtagtagccatacgtctcagaattctaaatgatgatatacctgtttttatttcagcgagtttagccttttgataaatttcttcttgctttttcgacatattaacgtatcgcattaatactgttttcttagcgaatgatgcagacccttctacgtcatcaaaaatagaaaactcgttattaactatgtacgaacataggcctcctagtttggagactaattctttctcatcaactagacgtttattctcaaatagcgattggtgttgtaaggatcctggtcgtagtaagttaaccaacatggtgaattcttgcacactattaacgataggtgtagccgataaacaaatcatcttatggttttttaatgcgatggtcttagataaaaaattatatactgaacgagtaggacggatcttaccatcttctttgattaatgatttagaaatgaagttatgacattcatcaataatgacgcatattctactcttggaattaatagttttgatattagtaaaaaatttatttctaaaattttgatcatcgtaattaataaaaatacaatccttcgttatctctggagcgtatctgagtatagtgttcatccaaggatcttctatcaaagcctttttcaccaataagataatagcccaattcgtataaatatccttaagatgtttgagaatatatacagtagtcattgttttaccaacacccgtttcatggaacaataaaagagaatgcatactgtctaatcctaagaaaactcttgctacaaaatgttgataatccttgaggcgtactacgtctgttcccatcatttcaacaggcatattagtagttctgcgcaatgcataatcgatataggccgcgtgtgatttactcatttatgagtgataagtaataactatgttttaaaaatcacagcagtagtttaactagtcttctctgatgtttgttttcgatactttttgaatcagaagtcatactagaataaagcaacgagtgaacgtaatagagagcttcgtatactctattcgaaaactctaagaacttattaatgaattccgtatccactggattgtttaaaatactaaattgaacactgttcacatccttccaagaagaagacttagtgacggacttaacatgagacataaataaatccaaattttttttacaaacatcactagccaccataatggcgctatctttcaaccagctatcgcttacgcattttagcagtctaacatttttaaagagactacaatatattctcatagtatcgattacacctctaccgaataaagttggaagtttaataatacaatatttttcgtttacaaaatcaaataatggtcgaaacacgtcgaaggttaacatcttataatcgctaatgtatagattgttttcagtgagatgattattagatttaatagcatctcgttcacgtttgaacagtttattgtgtgcgctgaggtcggcaactacggcgtccgctttagtactcctcccataatactttacgctattaatctttaaaatttcatagactttatctagatcgctttctggtaacatgatatcatgtgtaaaaagttttaacatgtcggtcggcattctatttagatcattaactctagaaatctgaagaaagtaattagctccgtattccagactaggtaatgggcttttacctaaagacaagttaagttctggcaatgtttcataaaatggaagaaggacatgcgttccctcccggatattttttacaatttcatccatttacaactctatagtttgttttcattattattagttattatctcccataatcttggtaatacttaccccttgatcgtaagataccttatacaggtcattacatacaactaccaattgtttttgtacataatagattggatggttgacatccatggtggaataaactactcgaacagatagtttatctttccccctagatacattggccgtaatagttgtcggcctaaagaatatctttggtgtaaagttaaaagttagggttcttgttccattattgctttttgtcagtagttcattataaattctcgagatgggtccgttctctgaatatagaacatcatttccaaatctaacttctagtctagaaataatatcggtcttattcttaaaatctattcccttgatgaagggatcgttaatgaacaaatccttggcctttgattcggctgatctattatctccgttatagacgttacgttgactagtccaaagacttacaggaatagatgtatcgatgatgttgatactatgtgatatgtgagcaaagattgttctcttagtggcatcactatatgttccagtaatggcggaaaactttttagaaatgttatatataaaagaattttttcgtgttccaaacattagcagattagtatgaagataaacactcatattatcaggaacattatcaatttttacatacacatcagcatcttgaatagaaacgataccatcttctggaacctcaacaatctcggcagactccggataaccagtcggtgggccatcactaacaataactagatcatccaacaatctactcacatatgcatctatataatctttttcatcttgtgagtaccctggatacgaaataaatttattatccgtatttccataataaggtttagtataaacagagagcgatgttgccgcatgaacttcagttacagtcgccgttggttggtttatttgacctattactctcctaggtttctctataaacgatggtttaatttgtacattcttaaccatatatccaataaagctcaattcaggaacataaacaaattctttgttgaacgtttcaaagtcgaacgaagagtcacgaataacgatatcggatactggattgaaggttaccgttacggtaatttttgaatcggatagtttaagactgctgaatgtatcttccacatcaaacggagttttaatataaacgtatactgtagatggttctttaatagtgtcattaggagttaggccaatagaaatatcattaagttcactagaatatccagagtgtttcaaagcaattgtattattgatacaattattatataattcttcgccctcaatttcccaaataacaccgttacacgaagagatagatacgtgattaatacatttatatccaacatatggtacgtaaccgaatcttcccatacctttaacttctggaagttccaaactcagaaccaaatgattaagcgcagtaatatactgatccctaatttcgaagctagcgatagcctgattgtctggaccatcgtttgtcataactccggatagagaaatatattgcggcatatacaaagttggaatttgactatcgactgcgaagacattagaccgtttaatagagtcatccccaccgatcaaagaattaatgatagtattattcattttctatttaaaatggaaaaagcttacaataaactccgtagagaaatatctataatttgtgagttttccttaaagtaacagcttccgtaaacgccgtctttatctcttagtaggtttattgtatttatgaccttttccttatcttcatagaatactaaaggcaacaaagaaatttttggttcttctctaagagctacgtgagacttaaccatagaagccaacgaatccctacatattttagaacagaaatacccaacttcaccacccttgaatgtctcaatactaataggtctaaaaaccaaatcttgattacaaaaccaacacttatcaattacactatttgtcttaatagacacatctgccatagatttataatactttggtagtatacaagcgagtgcttcttctttagcgggcttaaagactgctttaggtgctgaaataaccacatctggaaggcttactcgcttagccatttaattacggaactatttttttatacttctaatgagcaagtagaaaacctctcatctacaaaaacatactcgtgtccataatcctctaccatagttacacgttttttagatctcatatgtgctaaaaagttttcccatactaattggttactattatttttcgtataatttttaacagtttgaggttttagatttttagttacagaagtgatatcgaatattttatccaaaaagaatgaataattaattgtcttagaaggagtgttttcttggcaaaagaataccaagtgcttaaatatttctactacttcattaatcttttctgtactcagattcagtttctcatcttttacttgattgattatttcaaagactaacttataatcctttttatttattctctcgttagccttaagaaaactagatacaaaatttgcatctacatcatccgtggatatttgatttttttccatgatatccaagagttccgagataatttctccagaacattgatgagacaataatctccgcaatacatttctcaaatgaataagtttattagacacatggaagtttgactttttttgtacctttgtacatttttgaaatacagactcgcaaaaaatacaatattcatatccttgttcagatactataccgttgtgtctacaaccgctacataatcgtagattcatgttaacactctacgtatctcgtcgtccaatattttatataaaaacattttatttctagacgttgccagaaaatcctgtaatatttttagttttttgggctgtgaataaagtatcgccctaatatggttaccgtcctccgccaatatagtagttaaattatccgcacatgcagaagaacaccgcttaggcggattcagtacaatgttatatttttcgtaccaactcatttaaatatcataatctaaaatagttctgtaatatgtctagcgctaatatattgatcataatcctgtgcataaattaagatacaacaatgtctcgaaatcatcgacatggcttcttccatagttagaagatcgtcgtcaaagttagcaacgtgattcatcaacatttgctgttttgaggcagcaaatactgaaccgtcgccattcaaccattcataaaaaccatcgtctgaatccattgataatttcttgtactggtttttgagagctcgcatcaatctagcatttctagctcccggattgaaaacagaaagaggatcgtacatccagggtccattttctgtaaatagaatcgtataatgtcccttcaagaagatatcagacgatccacaatcaaagaattggtctccgagtttgtaacaaactgcggactttaacctatacatgataccgtttagcatgatttctggtgatacgtcaatcggagtatcatctattagagatctaaagccggtgtaacattctccaccaaacatattcttattctgacgtcgttctacataaaacatcattgctccattaacgataacaggggaatgaacagcactacccatcacattagttcccaatggatcaatgtgtgtaactccagaacatcttccatatcctatgttaggaggagcgaacaccactcttccactattgccatcgaatgccatagaataaatatccttggaattgatagaaatcggactgtcggatgttgtgatcatcttcataggattaacaactatgtatggtgccgcctgaagtttcatatcgtaactgatgccgtttataggtctagccacagaaaccaacgtaggtctaaatccaactatagacaaaatagaagccaatatctgttcttcatctgtcataacttgagagcatccagtatgaataatcttcattagatggggatctaccgcatcatcatcgttacaataaaaaattcccattctaatgttcataattgcttttctaatcatggtatgcatgtttgctctctgaatctctgtggaaattagatctgatacacctgtaatcactatcggattatcctccgtaagacgattaaccaacaacatataattataagactttacttttctaaattcataaagttgctggattaggctataggtgtctccatgtacatacgcgttctcgagcgcaggaagtttaataccgaatagtgccatcagaataggatgaatatagtaattagtttctggttttctataaataaaagacaaatcttgtgaactagacatatcggtaaaatgcatggattggaatcgtgtagtcgacagaagaatatgatgattagatggagagtatattttatctaactctttgagttggtcaccgattctaggactagctcgagaatgaataagtactaaaggatgagtacatttcacagaaacactagcattgttcaatgtgctctttacatgggtaaggagttgaaatagctcgtttctatttgttctgacaatatttagtttattcataatgttaagcatatcctgaatagtaaagttagatgtgtcatacttgttagtagttagatatttagcaattgcattcccatcatttctcaatctcgtactccaatcatgcgtggatgctacttcgtcgatggaaaccatacaatcctttttgataggctgttgagattgattatttcctgcacgtttaggtttggtacgttgatttctagcccctgcggatataaagtcatcgtctacaattttggataatgaattgcatacactacaagacaaagatttatcagaagtgtgaatatgatcttcatctaccaaagaaagagtttgattagtataactagattttagtcctgcgttagatgttaaaaaaacatcgctattgaccacggcttccattatttatattcgtagtttttactcgaaagcgtgattttaatattcaatcttattacttttggaatcgttcaaaacctttgactaattgtagaatttgatctattgccctacgcgtatactcccttgcatcatatacgttcgtcaccagatcgtttgtttcggcctgaagttggtgcatatctctttcaacattcgacatgagatccttaagggccatatcgtctagattttgttgagatgctgctcctggatttggattttgttgtgctgttgtacatactgtaccaccagtaggtgtaggagtacatacagtggccacaataggaggttgaggaggtgtaaccgttggagtagtacaagaaatacttccatccgattgttgtgtacatgtagttgttggtaacgtctgagaaggttgggtagatggcggtgtcgtcgtcttttgatctttattaaatttagagataatatcctgaacagcattgctcggcgtcaacgctggaaggagtgaactcgccggcgcatcagtatctgcagacagccaatcaaaaagattagacatatcagatgatgtattagtttgttgtcgtggttttggtgtaggagccggtgtagctgttggaaccggctgtggagttatatgaatagttggttgtagcggttggataggctgtctgctggcggccatcatattatctctagctagttgttctcgcaactgtctttgataatacgactcttgagactttagtcctatttcaatcgcttcatcctttttcgtatccggatccttttcttcagaataatagattgacgactttggtgtagaggattctgccagcccctgtgagaacttgttaaagaagtccatttaaggctttaaaattgaattgcgattataagattaaatggcagacacagacgatattatcgactatgaatccgatgatctcaccgaatacgaggatgatgaagaagaggaagaagatggagagtcactagaaactagtgatatagatcccaaatcttcttataagattgtagaatcagcatccactcatatagaagatgcgcattccaatcttaaacatatagggaatcatatatctgctcttaaacgacgctatactagacgtataagtctatttgaaatagcgggtataatagcagaaagctataacttgcttcaacgaggaagattacctctagtttcagaattttctgacgaaacgatgaagcaaaatatgctacatgtaattatacaagagatagaggagggttcttgtcctatagtcatcgaaaagaacggagaattgttgtcggtaaacgattttgacaaagatggtctaaaattccatctagactatattatcaaaatttggaaacttcaaaaacgatattagaatttatacgaatatcgttctctaaatgtcacaatcaagtctcgcatgttcagcaatttattgtcgtactttatatcgtgttcattaacgatatcttgcaaaatagtaatgattctatcttccttcgatagatattcttcagagattattgtcttatattctttcttgttatcagatatgaatttgataagactttgaacattattgatacccgtctgtttaattttttctacagatattttagttttggcagattctatcgtatctgtcaatagacatccaacatcgacattcgacgtcaattgtctataaatcaacgtataaattttagaaataacattagcgaattgttgtgcattgatgtcgttattctgaaacagtatgattttaggtagcattttcttaacaaagagaacgtatttattgttactcagttgaacagatgatatatccagattactaacgcatctgattccatataccaaactttcagaagaaatggtgtacaattgtttgtattcattcaatgtctctttttcagaaattagtttagagtcgaatactgcaataattttcaagagatagttttcatcagataagattttatttagtgtagatatgataaaactattgttttgttggagaacttgatacgccgcgttctctgtagtcgacgctctcaaatgggaaacaatctccattatttttttggaatcggatacaatatcttcggtatcttgacgcaatctagtatacatagagttaagagaaattagagtttgtacattaagcaacatgtctctaaatgtggctgcaaacttttccttttccacatcatctagtttattatataccgatttcacaacggcaccagatttaaggaaccagaatgaaaaactctgataactacaatatttcatcatagttacgattttatcatcttctatagttggtgtaatagcgcatacctttttctccaagactggaaccaacgtcataaaaatgtttaaatcaaaatccatatcaacatctgatgcgctaagaccagtctcgcgttcaagattatctttactaatggtgacgaactcatcgtatagaactctaagtttgtccattatttatttacagatttagttgtttaatttatttgtgctcttccagagttgggatagtatttttctaacgtcggtattatattattaggatctacgttcatatgtatcataatattaatcatccacgttttgataaatctatctttagcttctgaaataacgtatttaaacaaaggagaaaaatatttagctacggcatcagacgcaataacattttttgtaaatgtaacgtatttagacgacagatcttcgttaaaaagttttccatctatgtagaatccatcggttgttaacaccattcccgcgtcagattgaataggagtttgaatagtttgttttggaaatagatccttcaataacttatagttgggtgggaaaaaatcgattttatcactagactctttcttttttactatcattacctcatgaactatttcttgaatgagtatatgtattttctttcctatatcggacgcgttcattggaaaatataccatgtcgttaactataagaatatttttatcctcgtttacaaactgaataatatcagatgtagttcgtaaacgaactatatcatcaccagcacaacatctaactatatgatatccactagtttcctttagtcgtttattatcttgttccatattagcagtcattccatcatttaagaaggcgtcaaagataatagggagaaatgacattttggattctgttacaactttaccaaaattaaggatatacggacttactatctttttctcaacgtcgatttgatgaacacacgatgaaaatgtacttcgatgagattgatcatgtagaaaacaacaagggatacaatatttccacatatcatgaaatatattaagaaatcccaccttattatatttccccaaaggatccatgcatgtaaacattatgccgttatcattaataaagacttctttctcatcggatctgtaaaagttgttactgatttttttcattccaggatctagataattaataatgatgggttttctattcttattctttgtattttggcatatcctagaccagtaaacagtttccactttggtaaaatcagcagacttttgaacgctattaaacatggcattaatggcaataactaaaaatgtaaaatatttttctatgttaggaatatggtttttcactttaatagatatatggtttttggccaaaatgatagatatttttttatccgaggatagtaaaatattattagtcgccgtctctataaaaatgaagctagtctcgatatccaattttattctagaattgataggagtcgccaaatgtaccttatacgttatatctcccttgatgcgttccatttgtgtatctatatcggacacaagatctgtaaatagttttacgttattaatcatcacggtatcgccgtcgctagataacgctaatgtaccatccaagtcccaaatggagagatttaactgttcatcgtttagaataaaatgattaccggtcatattaataaagtgttcatcgtatctagataacaacgacttataattaatgtccaagtcttgaactcgctgaatgatcttttttaacccagttagttttagattggtacgaaatatattgttaaactttgattctacagtaatgtccaaatctagttgtggaaatacttccatcaacattgtttcaaacttgataatattattatctacatcttcatacgatccaaattccggaatagatgtatcgcacgctctggccacccagataaccaaaaagtcacacgctccaggatatacattgtataaaaagctatcgttttttagtagtgtttttttctgagtatatacgaagggattaaaaatagtattatcaacgtaactatattccaaattattcttatgagaatagataataatatcgtccttaatatctaacaaatttcctaaatatccctttaattgagtcattcgaagcgtcaatagaatatgtctcttaactatttccggctgttgtatatttaaatgacttcgtaaaaaataatatatgggcgacttctcatctatgtaatcatatggagtgagatatagggctcgttctacctcctgccccttacccacctgtaataccaattgcggacttactatatatcgcatatttatatcgtggggtaaagtgaaaatctactaccgatgatgtaagtcttacaatgttcgaaccagtaccagatcttaatttggaggcctccgtagaactaggggaggtaaatatagatcaaacaacacctatgataaaggaaaatagcggttttatatcccgtagtagacgtctattcgcccatagatctaaggatgatgagagaaaactagcactacgattctttttacaaagactttattttttagatcatagagagattcattatttgttcagatgcgttgacgctgtaaaagacgtcactattaccaaaaaaaataacattatcgtggcgccttatatagcacttttaactatcgcatcaaaaggatgcaaacttacagaaacaatgattgaagcattctttccagaactatataatgaacatagtaagaaatttaaattcaactctcaagtatccatcatccaagaaaaactcggataccagtttggaaactatcacgtttatgattttgaaccgtattactctacagtagctctggctattcgagatgaacattcatctggcatttttaatatccgtcaagagagttatctggtaagttcattatctgaaataacatatagattttatctaattaatctaaaatctgatcttgttcaatggagtgctagtacgggcgctgtaattaatcaaatggtaaatactgtattgattacagtgtatgaaaagttacaactggtcatagaaaatgattcacaatttacatgttcattggctgtggaatcaaaacttccaataaaattacttaaagatagaaatgaattatttacaaaattcatcaacgagttaaaaaagaccagttcattcaagataagcaaacgcgataaggatacgctactaaaatattttacttaggactggagttagaatttatagacgactcatttcgtttatcattattagtattcttcttgttatcttgttcagaaatatacagcaatgctatgcctaatactaaatacattatcatgcttgcaatggctctaacaacgacgaaccaaaatgaatttggtcgtagcttttgttcacaaaaatacataaagaaatgtctacataaatctatggcgccattggctacttgaaatagcgccagtcctcctacagattttaatatagctgtataacatgacatttattcatcatcaaaagagacagagtcaccatctgtcatatttagattttttttcatgtgttcaaagtatcctctactcatttcattataatagtttatcatacttagaattttaggacggatcaatgagtaagacttgactagatcgtcagtagtaatttgtgcatcgtctattctgcatccgcttcgtcgaataatgtatagcatcgctttgagattctccatagctatcaagtctttatacaatgacatggaaatatctgtgaatactttatacttctccaacatcgatgccttaacatcatcgcctactttagcattgaaaatacgttctattgtgtagatggatgtagcaagatttttaaacaacaatgccatcttacacgatgattgcctcaagtctccaatcgtttgtttagaacgattagctacagagtccaatgcttggctgactagcatattattatctttagaaattgtattcttcaatgaggcgtttatcatatctgtgatttcgttagtcatattacagtctgactgggttgtaatgttatccaacatatcacctatggatacggtacacgtaccagcatttgtaataatcctatctaagatgttgtatggcattgcgcagaaaatatcttctcctgtaatatttccactctcgataaatctactcagattattcttaaatgccttattctctggagaaaagatatcagtgtccatcatttcattaatagtatacgcagaaaagataccacgagtatcaattctatccaagatacttatcggttccgagtcacagataatggtttcctctccttcgggagatcctgcatagaaatatctaggacaatagtttctatactgtctgtaactctgataatctctaaagtcactaactgataccatgaaattgagaagatcaaacgctgaagtaattaatttttctgcctcgtttttactacaactagttttcatcaatgtagtgacgatgtattgtttagttacttttggtctaatactgatgatagagatattattacttcccataatggatcttctagtagtcaccttaaagcccattgatgcaaatagcagatagataaagtcttggtatgactcctttctaatatagtacggactacctttgtcacccaactttatacccacataagccataacaacctctttaatagccgtttcatgaggtttatcagccatgagcctgagtagttggaagaatctcatgaatcctgtctcagaaagtcctatatgcatgatagatttatctttcctgggaaactctcgtatagtcatagatgaaatactcttcaaagtttctgaaataagattagtaacagtcttacctccgactactctaggtaacaaacaaactctaataggtgttttctctgcggagataatatcagaaaggatagagcaataagtagtattattgtgattataaagaccgaatacataacaggtagaatttataaacatcatgtcctgaaggtttttagacttgtattcctcgtaatccataccgtcccaaaacatggatttggtaactttgatagccgtagatctttgttccttcgccaacaggttaaagaaattaataaagaatttgtggtttctacctatgtctacaaattgcacgtttggaagcgccacggttacattcactgcagcattttgaggatcgcgagtatgaagtacgatgttattgtttactggtatatctggaaagaattctaccagtctaggaataagagattgatatcgcatagaaatacaaaagttcataatctcatcatctaagagcattttgttaccattgtaataaatatccactctgtcatatgtataaatgaagtactgttcaaacatgatgagatgtttatatgttggcatagtagtgagatctacgtttggtaatggcaatgtattaagattaactccataatgtctagcagcatctgcgatgttataagcgttgtcaaagcggggtcgatcttgtgctgttatatattgtctaacacctataagattatcaaaatcttgtctgcttaatacaccgttaacaatttttgccttgaattcttttattggtgcattaataacatccttatagaggatgttaaacaaataagtgttatcaaagttaagatctggatatttcttttctgctagaacatccattgagtcggagccatctggtttaatataaccaccgataaatctagctctgtattctgtatccgtcaatctaatattaagaaggtgttgagtgaaaggtggaagatcgtaaaagctgtgagtattaatgataggattagtttccgaactaatgttaattggggtattaataatatctatatttccagcgttaagtgtaacattaaacagttttaattcacgtgacgtggtatcaattaaataattaatgcccaatttggatatagcagcctgaagctcatcttgtttagttacggatcctaatgagttattaagcaatatatcgaacggatgaacgaaggttgttttaagttggtcacatactttgtaatctagacatagatgcggaagaacggtagaaactatacgaaataaatattcagagtcctctaattgatcaagagtaactattgacttaataggcatcatttatttagtattaaatgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattctccggccactattatcgaacgagtacaacctcatactactattattgacgatactccacctcctacgtttcgtagagagttattgatatcggaacaacgtcaacaacgagaaaaaagatttaatattacagtatcgaaaaatgctgaagcaataatggaatctagatctatgatatcttctatgccaacacaaacaccatccttgggagtagtttatgataaagataaaagaattcagatgttggaggatgaagtggttaatcttagaaatcaacgatctaatacaaaatcatctgataatttagataattttaccagaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacgaaaaattatcgtcactaacgtgattattattgtcataaatattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaatttaatacattcccatatccagacaacaatcgtctggattaatctgttcctgtcgtctcataccggacgacatattaatctttttattagtaggcatctttttagatggtttctttttcccagcattaactgagtcgatacctagaagatcgtgattgatctctccgaccattccacgaacttctaattggccgtctctgacggtaccataaactattttaccagcattagtaacagcttggacaatctgaccatccatcgcattgtacgatgtagtagtaactgttgttctacgtctaggagcaccagaagtatttttggagcccttggatgttgatgtagaagaagacgaggattttgattttggtttacatgtaatacattttgtatcacatgcgccggcagtcacatctgtttgagaattaagattattgttgcctcctttgacggctgcatctccaccgatttgcgctagtagatttttaagctgtggtgtaatcttattaactgtttcgatataatcatcgtaactgcttctaacggctaaattttttttatccgccatttagaagctaaaaatatttttatttatgcagaagatttaactagattatacaatgaactaatatgatccttttccagattatttacaaacttggtattttttggttctggaggaggcgaatttaaattcggacttggatttggattttgtgggttcttgatcttattatacagcgcatataggatggcgacggtaactgctacgcaaataccgatcaacaaaagaataccaatcatttattgacaataacttcactattgatcaagtatgcaatatatcatcttttcactaaataagtagtaataatgattcaacaatgtcgagatatatggacgataataatttagttcatggaaatatcgctatgattggtatgaatgactccgctaactctgtggggcgcgcagtgctttccccacatagaataaattagcattccgactgtgataataataccaagtataaacgccataatactcaatactttccatgtacgagtgggactggtagacttactaaagtcaataaaggcgaagatacacgaaagaatcaaaagaatgattccagcgattagcacgccggaaaaataatttccaatcataagcatcatatccatttaactaataaaaattttaaatcgccgaatgaacaaagtggaatataaaccatataaaaacaatagtttgtactgcaaaaataatatctatttttgttttcgaagatatggtaaaattaaatagtagtacacagcatgttataactaacagcagcaacggctcgtaattacttatcatttactagacgaaaaggtggtgggatattttcttgctcaaataatacgaatatatcacccatccattttatgcgatgtttatatactctaatctttaatagatctatagacgacgggtttaccaacaatatagattttatcgattcatctaatttaaacccttccttaaacgtgaatgatctattatctggcataacgatgactctacccgatgaatcggacaatgtactgggccatgtagaataaattatcaacgaattatcgtctacgaacatttatatcatttgttttaattttagtacgcgaataaatagatataaaatagaaaataacagatattacaaccaatgttatggccgcgcccaaccaggtaggcagttttattttatcttttactacaggttctcctggatgtacgtcaccaacggcggacgtagttctagtacaattagacgtaagttccgcttgggaattttttaacgctaaagagttaacgttaatcgtgcacccaacgtatttacatctagttctttgaacatcttgattataatataaccattttctatctctagattcgtcggtgcactcatgtaaccaacataccctaggtcctaaatatttatctccggaattagattttggataattcgcgcaccaacaatttctatttcctttatgatcgttacaaaagacgtataatgccgtatccccaaaagtaaaataatcaggacgaataattctaataaactcagaacaatatctcgcatccatatgtttggagcaaatatcggaataagtagacatagccggtttccgttttgcacgtaaccattctaaacaattggggtttccaggatcgtttctacaaaatccagtcatgaaatcatcacaatgttctgtcttgtaattattattaaatatttttggacagtgtttggtatttgtcttagaacaacattttgccacgctatcactatcgcccaggagataatccttttttataaaatgacatcgttgcccggatgctatataatcagtagcgtgttttaaatccttaatatattcaggagttacctcgttctgataatagattaatgatccaggacgaaatttgaaagaactacatggttctccatgaattaatacatattgtttagcaaattcaggaactataaaactactacaatgatctatcgacataccatctatcaaacaaaacttgggtttaatttctcccggagatgtttcataatagtacgtataactttcttctgcaaacttaacagctctattatattcaggataattaaaacctaattccatatatttgtctcgtatatctgctattcctggtgctattttgattctattaagagtaacggctgcccccatttttaataatcgtcagtatttaaactgttaaatgttggtatatcaacatttaccttatttcccgcagtataaggtttgttgcaggtatactgttcaggaatggttacatttatactttttctatagtcctgtctttcgatgttcatcacatatgcaaagaacagaataaacaaaataatgtaagaaataatattaaatatctgtgaattcgtaaatacattgattgccataataattacagcagctacaatacatacaatagacattcccacagtgttgccattacctccacgatacatttgagttactaagcaataggtaataactaagctagtaagaggcaatagaaaagatgagataaatatcatcaatatagagattagaggagggctatatagagccaagacgaacaaaatcaaaccgagtaacgttctaacatcattatttttgaagattcccaaataatcattcattcctccataatcgttttgcatcatacctccatctttaggcataaacgattgctgctgttcctctgtaaataaatctttatcaagcactccagcacccgcagagaagtcgtcaagcatattgtaatatcttaaataactcatttatatattaaaaaatgtcactattaaagatggagtataatctttatgccgaactaaaaaaaatgacttgtggtcaacccctaagtctttttaacgaagacggggatttcgtagaagttgaaccgggatcatcctttaagtttctgatacctaagggattttacgcctctccttccgtaaagacgagtctagtatttgaaacattaacaacgaccgataataaaattactagtatcaatccaacaaatgcgccaaagttatatcctcttcaacgcaaagtcgtatctgaagtagtttctaatatgaggaaaatgatcgaatcaaaacgtcctctatacatcactcttcacttggcgtgtggatttggtaagactattaccacgtgttatcttatggctacacacggtagaaaaaccgtcatttgcgtacccaataaaatgttaatacatcaatggaagacacaggtagaggcagtcggattggaacataagatatccatagatggagtaagtagtctattaaaggaactaaagactcaaagtccggatgtattaatagtagtcagtagacatctgacaaacgatgccttttgtaaatatatcaataagcattatgatttgttcatcttggatgaatcacatacgtataatctgatgaacaatacagcagttacaagatttttagcgtattatcctccgatgatgtgttattttttaactgctacacctagaccatctaacagaatttattgtaacagtattattaatattgccaagttatccgatctaaaaaaaactatctatgcagtagatagtttttttgagccatattccacagataatattagacatatgataaaacgattagatggaccatctaataaatatcatatatataccgagaagttattatctgtagacgagcctagaaatcaacttattcttaataccctggtagaagaattcaagtcaggaactattaatcgcattttagttattactaaactacgtgaacatatggtattcttctacaaacgattattagattttttcggatcagaggttgtatttataggagacgcccaaaatagacgtactccagatatggtcaaatcaatcaaggaactaaatagatttatattcgtatccaccttattttattccggtactggtttagatattcctagtttggattctttgttcatttgctcggcagtaatcaacaatatgcaaatagagcaattactagggagggtatgtcgagaaacagaactattagataggacggtatatgtatttcctagcacatccatcaaagaaataaagtacatgataggaaatttcgttcaacgaattattagtctgtctgtagataaactaggatttaaacaaaaaagttatcggaaacatcaagaatccgatcccacttctgtatgtacaacatcctccagagaagaacgtgtattaaatagaatatttaactcgcaaaatcgttaagaagtttaagcgacgatccgcatgctgcgcaggccagtgtattacccctcatagtattaatataatccaatgatacttttgtgatgtcggaaatcttaaccaatttagactgacaggcagaacacgtcatgcaatcatcatcgtcatcgataactgtagtcttgggcttctttttgcggctcttcattccggaacgcacattggtgctatccatttaggtagtaaaaaataagtcagaatatgccctatagcacgatcgtgcaaaacctggtatatcgtctctatctttatcacaatatagtgtatcgacatctttattattattgacctcgtttatcttggaacatggaatgggaacatttttgttatcaacggccacctttgccttaattccagatgttgtaaaattataactaaacagtctatcatcgacacaaatgaaattcttgtttagacgtttgtagtttacgtatgcggctcgttcgcgtctcattttttcagatattgcaggtactataatattaaaaataagaatgaaataacataggattaaaaataaagttatcatgacttctagcgctgatttaactaacttaaaagaattacttagtctgtacaaaagtttgaaattttcagattctgcggctatagaaaagtataattctttggtagaatggggaacatctacttactggaaaataggcgtgcaaaaggtagctaatgtcgagacgtcaatatctgattattatgatgaggtaaaaaataaaccgtttaatattgatccgggctattacattttcttaccggtatattttgggagcgtctttatttattcgaagggtaaaaatatggtagaacttggatctggaaactcttttcaaataccagatgatatgcgaagtgcgtgtaacaaagtattagacagcgataacggaatagactttctgagatttgttttgttaaacaatagatggataatggaagatgctatatcaaaatatcagtctccagttaatatatttaaactagctagtgagtacggattaaacatacccaaatatttagaaattgaaatagaggaagacacattatttgacgacgagttatactctattatagaacgctctttcgatgataaatttccaaaaatatccatatcgtatattaagttgggagaacttaggcggcaagttgtagactttttcaaattctcattcatgtatattgagtccatcaaggtagatcgtataggagataatatttttattcctagcgttataacaaaatcaggaaaaaagatattagtaaaagatgtagaccatttaatacgatccaaggttagagaacatacatttgtaaaagtaaaaaagaaaaacacattttccattttatacgactatgatggaaacggaacagaaactagaggagaagtaataaaacgaattatagacactataggacgagactattatgttaacggaaagtatttctctaaggttggtagtgcaggcttaaagcaattgactaataaattagatattaatgagtgcgcaactgtcgatgagttagttgatgagattaataaatccggaactgtaaaacgaaaaataaaaaaccaatcagcatttgatttaagcagagaatgtttgggatatccagaagcggattttataacgttagttaataacatgcggttcaaaatagaaaattgtaaggttgtaaatttcaatattgaaaatactaattgtttaaataacccgagtattgagactatatatggaaactttaaccagttcgtctcaatctttaatatcgtcaccgatgtcaaaaaaagattattcgagtgaaataatatgcgcctttgatataggtgcaaaaaatcctgccagaactgttttagaagtcaaggataactccgttagggtattggatatatcaaaattagactggagttctgattgggaaaggcacatagctaaagatttgtcacaatatgaatacactacagttcttctagaacgtcagcctagaaggtcgccgtacgtcaaatttatctattttattaaaggctttttatatcatacatcggctgccaaagttatttgcgtctcgcctgtcatgtctggtaattcatatagagatcgaaaaaagagatcggtcgaagcatttcttgattggatggacacattcggattgcgagactccgttccggatagacgcaaattagacgatgtagcggatagtttcaatttggctatgagatacgtattagataaatggaatactaattatacaccttataataggtgtaaatctagaaattacataaaaaaaatgtaataacgttagtaacgccattatggataatctatttacctttctacatgaaatagaagatagatatgccagaactatttttaactttcatctaataagttgcgatgaaataggagatatatatggtcttatgaaagaacgcatttcctcagaggatatgtttgataatatagtgtataataaagatatacatcatgccattaagaaactagtgtattgcgacatccaacttactaaacacattattaatcagaatacgtatccggtatttaacgattcttcacaagtgaaatgttgtcattatttcgatataaactcagataatagcaatattagctctcgtacagtagagatatttgagagggaaaagtcatctcttgtatcatatattaaaactaccaataagaagagaaaggtcaattatggggaaataaagaaaactgtacatggaggcactaatgcaaattacttttccggtaaaaagtctgatgagtatctgagcactacagtcaggtccaacattaatcaaccttggatcaaaaccatttctaagagaatgagagtagatatcattaatcactctatagtaacgcgtggaaaaagctctatattacaaactatagaaattatttttactaatagaacatgtgtgaaaatattcaaggattctactatgcacattattctatccaaggacaaggatgaaaaggggtgtatacacatgattgacaaattattctatgtctattataatttatttctgttgttcgaggatatcatccaaaacgagtactttaaagaagtagctaatgttgtaaaccacgtactcacggctacggcattagatgagaaattattcctaattaagaaaatggctgaacacgatgtttatggagttagcaatttcaaaatagggatgtttaacctgacatttattaagtcgttggatcataccgttttcccctctctgttagatgaggatagcaaaataaagttttttaaggggaaaaagctcaatattgtagcattacgatctctggaggattgtataaattacgtgactaaatccgagaatatgatagaaatgatgaaggaaagatcgactattttaaatagcatagatatagaaacggaatcggtagatcgtctaaaagaattgcttctaaaatgaaaaaaaaacactaattcagaaatggatcaacgactcggatataagtttttggtgcctgatcctaaagccggagttttttatagaccgttacatttccaatatgtatcgtattctaattttatattgcatcgattgcatgaaatcttgaccgtcaagcggccactcttatcgtttaagaataatacagaacgaattatgatagaaattagcaatgttaaagtgactcctccagattactcacctataatcgcgagtattaaaggtaagagttatgacgcattagccacgttcactgtaaatatctttaaagaggtaatgaccaaagagggtatatccatcactaaaataagtagttatgagggaaaagattctcatttgataaaaattccgctactaataggatacgggaataaaaatccacttgatacagccaagtatcttgttcctaatgtcataggtggagtctttatcaataaacaatctgtcgaaaaagtaggaattaatctagtagaaaagattacaacatggccaaaatttagggttgttaagccaaactcattcactttctcgttttcctccgtatcccctcctaatgtattaccgacaagatatcgccattacaagatatctctggatatatcacaattggaagcgttgaatatatcatcgacaaagacatttataacggtcaatattgttttgctgtctcaatatttatctagagtgagtctagaattcattagacgtagtttatcatacgatatgcctccagaagttgtctatctagtaaacgcgataatagatagtgctaaacgaattactgaatctattactgactttaatattgatacatacattaatgacctggtggaagctgaacacattaaacaaaaatctcagttaacgatcaacgagttcaaatatgaaatgctgcataactttttacctcatatgaactatacacccgatcaactaaagggattttatatgatatctttactaagaaagtttctctactgtatctaccacacttctagatatccagatagagattcgatggtttgtcatcgcatcctaacgtacggcaaatattttgagacgttggcacatgatgaattagagaattacataggcaacatccgaaacgatatcatgaacaatcacaagaacagaggcacttacgcggtaaacattcatgtactaacaactcctggacttaatcatgcattttctagtctattgagtggaaagttcaaaaagtcagacggtagttatcgaacacatcctcactattcatggatgcagaatatttctattcctaggagtgttggattttatccggatcaagtaaagatttcaaagatgttttctgtcagaaaataccatccaagtcaatatctttacttttgttcatcggacgttccggaaagaggtcctcaggtaggtttagtatctcaattgtctgtcttgagttccattacaaatatactaacgtctgagtatttggatttggaaaagaaaatttgtgagtatatcagatcatattataaagatgatataagttactttgaaacaggatttccaatcactatagaaaatgctctagtcgcatctcttaatccaaatatgatatgtgattttgtaactgactttagacgtagaaaacggatgggattcttcggtaacttggaggtaggtattactttagttagggatcacatgaatgaaattcgcattaatattggagcgggaagattagtcagaccattcttggttgtggataacggagagctcatgatggatgtgtgtccggagttagaaagcagattagacgacatgacattctctgacattcagaaagagtttccgcatgtcatcgaaatggtagatatagaacaatttacttttagtaacgtatgtgaatcggttcaaaaatttagaatgatgtcaaaggatgaaagaaagcaatacgatttatgtgactttcctgccgaatttagagatggatatgtagcatcttcactagtgggaatcaatcacaattctggacccagagctattcttggatgtgctcaagctaaacaagctatctcttgtctgagctcggatatacgaaataaaatagacaatggaattcatttgatgtatccagagaggccaatcgtgattagtaaggctttagaaacttcaaagattgcggctaattgcttcggccaacatgttactatagcattaatgtcgtacaaaggtatcaatcaagaggatggaattatcatcaaaaaacaatttattcagagaggcggtctcgatattgttacagccaagaaacatcaagtagaaattccgttggaaaactttaataacaaagaaagagataggtctaacgcctattcaaaattagaaagtaatggattagttagactgaatgctttcttggaatccggagacgctatagcacgaaatatctcatcaagaactcttgaagatgattttgctagagataatcagattagctttgatgtttccgaaaaatataccgatatgtacaaatctcgcgttgaacgagtacaagtagaacttactgacaaagttaaggtacgagtattaaccatgaaagaaagaagacccattctaggagacaaatttaccactagaacgagtcaaaagggaacagtcgcgtatatcgcggatgaaacggaacttccatacgatgaaaatggtatcacaccagatgtcattattaattctacatccatcttctctagaaaaactatatctatgttgatagaggttattttaacagccgcatattctgctaagccgtacaacaataagggagaaaaccgacctgtctgttttcctagtagtaacgaaacatccatcgatacatatatgcaattcgctaaacaatgttatgagcattcaaatccgaaattgtctgatgaagaattatcggataaaatcttttgtgaaaagattctctatgatcctgaaacggataagccttatgcatccaaagtattttttggaccaatttattacttgcgtctgaggcatttaactcaggacaaggcaaccgttagatgtagaggtaaaaagacgaagctcattagacaggcgaatgagggacgaaaacgtggaggaggtatcaagttcggagaaatggagagagactgtttaatagcgcatggtgcagccaatactattacagaagttttgaaagattcggaagaagattatcaagatgtgtatgtttgtgaaaattgtggagacatagcagcacaaatcaagggtattaatacatgtcttagatgttcaaaacttaatctctctcctctcttaacaaaaattgataccacgcacgtatctaaagtatttcttactcaaatgaacgccagaggcgtaaaagttaaattagatttcgaacgaaggcctccttcgttttataaaccattagataaagttgatctcaaaccgtcttttctggtgtaatattctagtttggtagtagatacatatcaatatcatcaaattcgagatccgaattataaaatgggcgtggattgttaactatagaatcggacgtctgatattcgaaaatctgtggagttttaggttttggtggaggtgtaactgctacttgggatactgaagtctgatattcagaaagctgggggatgttctggttcgacatccaccgatggtgtcacatcactaatcggttcggtaacgtctgtggacgatggaggcaccacttctacaggttctggttctttatcctcagtcatcaacggagctacttcaatgcgaggaaatgtataatttggtaatggtttctcatgtggatctgaagaagaggtaagatatctactagaaagataccgatcacgttctagttctcttttgtagaacttaactttttctttctccgcatctagttgatattccaacctcttcacgttcgcatgggttacctccgcagtttttacgagcgatttcacgttcagccttcatgcgtcttatagcatgaattcgcttatcgttatcgggtttagcttctgtcaccttagcaattccttttttattaaactctacataatcatatccatttctattgtttgttctaatataaacgagtatagcatcattgctaaatttttcaatagtatcgaaaacagaatatcctaaaccatataatatatattcaggaacactcaaactaaatgtccaggattctcctaaatacgtaaactttaatagtgcgaaatcattcaaaaatctaccacttatagatagatagatagtacataaatgcgtatagtagtctacctatctctttattatgaaaaccggcattacgatcatatatgtcgtgatatacctgtgatccgtttacgttaaaccataaatacatgggtgatcctataaacatgaatttatttctaattctcagagctatagttaattgaccgtgtaatatttgcttacatgcatacttgatacgatcattaataagatttttatcattgctcgttatttcagaatcgtatatataaggagtaccatcgtgattcttaccagatattatacaaaatactatatataaaatatattgacccacgttagtaatcatgtaaatgtttaacgttttaaattttgtattcaatgatccattatcatacgctagcatggtcttatgatattcattctttaaaatataatattgtgttagccattgcattggggctcctaatggagattttttattctcatccattttaggataggctttcataaagtccctaataacttcgtgaataatgtttctatgttttctactgatgcatgtatttgcttcgatttttttatcccatgtttcatctatcatagatttaaacgcagtaatgctcgcaacattaacatcttgaaccgttggtacaattccgttccataaatttataatgttcgccatttatataactcattttttgaatatacttttaattaacaaaagagttaagttactcatatggacgccgtccagtctgaacatcaatctttttagccagagatatcatagccgctcttagagtttcagcgtgattttccaacctaaatagaacttcatcgttgcgtttacaacacttttctatttgttcaaactttgttgttacattagtaatctttttttccaaattagttagccgttgtttgagagtttcctcattgtcgtcttcatcggctttaacaattgcttcgcgtttagcctctggctttttagcagccgttgtagaaaaaaattcagttgctggaattgcaagatcgtcatctccggggaaaagagttccgtccatttaaagtacagattttagaaactgacactctgcgttatttatatttggtacaacacatggattataaatattgatgttaataacatcagaaaatgtaaagtctatacattgttgcatcgtgttaaattttctaatggatctagtattattgggtccaacttctgcctgaaatccaaatatggaagcggatacaaaaccgtttcctggataaaccacacatctccacttttgctttacatcagaaattgtgtcgttgacatcttgaactctcctatctaatgccggtgttccacctatagattttgaatattcgaatgctgcatgagtagcattaaattccttaatattgccataattttcatatattgagtaaccctggataaaaagtaaacacaccgcagccgtagctaccacaataaaaaaaattgatagagagttcatttataatctattagaagctgacaaaatttttttacacgcatcagacaatgctttaataaatagttcaacatctacttttgtcatatcgaaccgatggtatgattctaacctagaattacatccgaaaaagttgactatgttcatagtcattaagtcattaacaaacaacattccagactctggattataagacgatactgtttcgtcacaattacctaccttaatcatgtgattatgaatattggctattagagcaccttctaagaaatctataatatctttgaaacacgatttaaaatcaaaccacgaatatacttctacgaagaaagttagtttacccataggagaaataactataaatggagatctaaatacaaaatccggatctatgatagttttaacattattatattctctattaaatacctccacatctaaaaatgttaattttgaaactatgtcttcgtttattaccgtacctgaactaaacgctataagctctattgtttgagaactctttaaacgatattcttgaaatacatgtaacaaagtttcctttaactcggtcggtttatctaccatagttacagaatttgtatccttatctataatataataatcaaaatcgtataaagttatataattatcgcgttcagattgggatcttttcaaatagactaaaaaccccatttctctagtaagtatcttatgtatatgtttgtaaaatatcttcatggtgggaatatgctctaccgcagttagccattcctcattgacagcggtagatgtattagacaaaactattccaatgtttaacaagggccattttacgagattattaaatccttgtttgataaatgtagccaatgagggttcgagttcaacgacgattgaattctcttcccgcggatgctgcatgatgaacgacgggatgttgttcgattgatttggaattctttttcgactttttgtttatattaaatattttaaaatttatagcggatagcaattcatgtaccacggataatgtagacgcgtattgcgcatcgatatctttattattagataaatttatcaataaatgtgagaagtttgcctcgttaaggtcttccatttaaatattatataaacatttgtgtttgtatcttattcgtcttttatggaatagttttttactagtaaagctgcaattacacactttgtccgtaaaacataaatataaacaccagcttttatcaatcgttccaaaaagtcgacggcggacatttttaacatggcatctattttaaatacacttaggtttttggaaaaaacatcattttataattgtaacgattcaataactaaagaaaagattaagattaaacataagggaatgtcatttgtattttataagccaaagcattctaccgttgttaaatacttgtctggaggaggtatatatcatgatgatttggttgtattggggaaggtaacaattaatgatctaaagatgatgctattttacatggatttatcatatcatggagtgacaagtagtggaacaatttacaaattgggatcgtctatcgatagactttctctaaataggactattgttacaaaagttaataattataattatgatacattttttgacgatgatgattgatcgctattgcacaattttgtttttttactttctaatatagcgtttagattctttttcatgtgcgaatattgatttactaaaatatctatgtttaacttttgttctataacgtccttatcggcggtatcggtacatatacgtaattcaccttcacaaaatacggagtcttcgataataatagccaatcgattattggatctagctgtctgtatcatattcaacatgtttaatatatcctttcgtttcccctttacaggcatcgatcgtagcatattttccgcgtctgagatggaaatgttaaaactacaaaaatgcgtaatgttagcccgtcctaatattggtacgtgtctataagtttggcatagtagaataatagacgtgtttaaatgccttccaaagtttaagaattctattagagtattgcattttgatagtttatcgcctacatcatcaaaaataagtaaaaagtgtgctgattttttatgattttgtgcgacagcaatacatttttctatgttacttttagttcgtatcagattatattctagagattcctgactactaacgaaattaatatgatttggccaaatgtatccatcataatctggattataaacgggtgtaaacaagaatacatgtttatattttttaactagtgtagaaaacagagatagtaaatagatagtttttccagatccagatcctcccgttaaaaccattctaaacggcatttttaataaattttctcttgaaaattgtttttcttggaaacaattcataattatatttacagttactaaattaatttgataataaatcaaaatatggaaaactaaggtcgttagtagggaggagaacaaagaaggcacatcgtgacataaataacatttattatcatgatgacaccagaaaacgacgaagagcagacatctgtgttctccgctactgtttacagagacaaaattcagggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacgcaatatgatcacaaagaaagctgtaatggtttatattaccagggttcttgttatatattacattcagactaccagttattctcggatgctaaagcaaattgcactgcggaatcatcaacactacccaataaatccgatgtcttgactacctggctcattgattatgttaaggatacatggggatctgatggtaatccaattacaaaaactacatccgattatcaagattctgatgtatcacaagaagttagaaagtatttttgtgttaaaacaatgaactaatatttatttttgtacattaataaatgaaatcgcttaatagacaaactgtaagtaggtttaagaagttgtcggtgccggtcgctataatgatgatactctcaaccattattagtggcataggaacatttctgcattacaaagaagaactgatgcctagtgcttgcgccaatggatggatacaatacgataaacattgttatttagatactaacattaaaatgtctacagataatgcggtttatcagtgtcgtaaattacgagccagattgcctagaccggatactagacatctgagagtattgtttagtattttttataaagattattgggtaagtttaaaaaagaccaatgataaatggttagatattaataatgataaagatatagatattagtaaattaacaaattttaaacaactaaacagtacgacggatgctgaagcgtgttatatatacaagtctggaaaactggttaaaacagtatgtaaaagtactcaatctgtactatgtgttaaaaaattctacaagtgacaacaaaaaatgaattaataataagtcgttaacgtacgccgccatggacgccgcgtttgttattactccaatgggtgtgttgactataacagatacattgtatgatgatctcgatatctcaatcatggactttataggaccatacattataggtaacataaaaactgtccaaatagatgtacgggatataaaatattccgacatgcaaaaatgctactttagctataagggtaaaatagttcctcaggattctaatgatttggctagattcaacatttatagcatttgtgccgcatacagatcaaaaaataccatcatcatagcatgcgactatgatatcatgttagatatagaagataaacatcagccattttatctattcccatctattgatgtttttaacgctacaatcatagaagcgtataacctgtatacagctggagattatcatctaatcatcaatccttcagataatctgaaaatgaaattgtcgtttaattcttcattctgcatatcagacggcaatggatggatcataattgatgggaaatgcaatagtaattttttatcataaaagttgtaaagtaaataataaaacaataaatattgaactagtagtacgtatattgagcaatcagaaatgatgctggtacctcttatcacggtgaccgtagttgcgggaacaatattagtatgttatatattatatatttgtaggaaaaagatacgtactgtctataatgacaataaaattatcatgacaaaattaaaaaagataaagagttctaattccagcaaatctagtaaatcaactgatagcgaatcagactgggaggatcactgtagtgctatggaacaaaacaatgacgtagataatatttctaggaatgagatattggacgatgatagcttcgctggtagtttaatatgggataacgaatccaatgttatggcgcctagcacagaacacatttacgatagtgttgctggaagcacgctgctaataaataatgatcgtaatgaacagactatttatcagaacactacagtagtacttaatgaagataccaaacagaatcctaactattcatccaatcctttcgtaaattataataaaaccagtatttgtagcaagtcaaatccgttcattacagaactcaacaataaatttagtgagaataatccgtttagacgagcacatagcgatgattatcttaataagcaagaacaagatcatgaacacgatgatatagaatcattggtgtgattagtttcctttttataaaattgaagtaatatttagtattattgctgccgtcacgttgtacaaatggagatattccctgtattcggcatttctaaaattagcaattttattgctaataatgactgtagatattatatagatacagaacatcaaaaaattatatctgatgagatcaatagacagatggatgaaacggtacttcttaccaacatcttaagcgtagaagttgtaaatgacaatgagatgtaccatcttattcctcatagattatcgacgattatactctgtattagttctgtcggaggatgtgttatctctatagataatgacgtcaatggcaaaaatattctaacctttcccattgatcatgctgtaatcatatccccactgagtaaatgtgtcgtagttagcaagggtcctacaaccatattggttgttaaagcggatatacctagcaaacgattggtaacatcgtttacaaacgacatactgtatgtaaacaatctatcactgattaattattcgccgttgtctgtattcattattagacgagttaccgactatttggatagacacatatgcgatcagatatttgcgaataataagtggtattccattataaccatcgacaataagcagtttcctattccatcaaactgtataggtatgtcctctgccaagtacataaattctagcatcgagcaagatactttaatacatgtttgtaacctcgagcatccattcgacttagtatacaaaaaaatgcagtcgtacaattctgtacctatcaaggaacaaatattgtacggtagaattgataatataaatatgagcattagtatttctgtggattaatagatttctagtatggggatcattaatcatctctaatctctaaatacctcataaaacgaaaaaaaagctattatcaaatactgtacggaatggattcattctcttctctttttatgaaactctgttgtatatctactgataaaactggaagcaaaaaatctgataaaaagaataagaataagatcaaggattattataaaataacaatagttcctggttcctcttccacgtctactagctcgtggtattatacacatgcctagtaatagtctctttgcgttgacggaaagcagactagaaataacaggctaaaatgttcagacaccataatagttcccaacccagataataacagagtaccatcaacacattcctttaaactcaatcccaaacccaaaaccgttaaaatgtatccggccaattgatagtagataatgaggtgtacagcgcatgatgatttacacagtaaccaaaatgaaaatactttagtaattataagaaatatagatggtaacgtcatcatcaacaatccaataatatgccggagagtaaacattgacggataaaacaaaaatgctccgcataactctatcatggcaataacacaaccaaatacttgtaagattcctaaattagtagaaaatacaacggatatcgatgtataagtgatctcgagaaataataagaataaagtaatgcccgtaaagataaacatcaacattgtttggtaatcattaaaccaattagtatgaagttgaactaatttcacagtagattttattccagtattatccccgcatgtataagtacctggtaagatatctttatattccataatcaatgagacatcactatctgataacgaatgaagtctagcactagtatgccatttacttaatattgtcgtcttggaagttttattataagttaaaatatcatggttatccaatttccatctaatatactttgtcggattatctatagtacacggaataatgatggtatcattacatgctgtatactctatggtctttgtagttgttataacaaccaacgtatagaggtatatcaacgatattctaactcttgacattttttatttatttaaaatgatacctttgttatttattttattctattttgctaacggtattgaatggcataagtttgaaacgagtgaagaaataatttctacttacttattagacgacgtattatacacgggtgttaatggggcggtatacacattttcaaataataaactaaacaaaactggtttaactaataataattatataacaacatctataaaagtagaggatgcggaaccaataacggaaatcccaaatgttggaaaatagacggttcagacgacccaaaacatagaggtagaggatacgctccttatcaaaatagcaaagtaacgataatcagtcacaacggatgtgtactatctgacataaacatatcaaaagaaggaattaaacgatggagaagatttgacggaccatgtggttatgatttatacacggcggataacgtaattccaaaagatggtttacgaggagcattcgtcgataaagatggtacttatgacaaagtttacattcttttcactgatactatcggctcaaagagaattgtcaaaattccgtatatagcacaaatgtgcctaaacgacgaaggtggtccatcatcattgtctagtcatagatggtcgacgtttctcaaagtcgaattagaatgtgatatcgacggaagaagttatagacaaattattcattctagaactataaaaacagataatgatacgatactatatgtattcttcgatagtccttattccaagtccgcattatgtacctattctatgaataccattaaacaatctttttctacgtcaaaattggaaggatatacaaagcaattgccgtctccagctcctggtatatgtttaccagctggaaaagttgttccacataccacgtttgaagtcatagaaaaatataatgtactagatgatattataaagcctttatctaaccaacctatcttcgaaggaccgtctggtgttaaatggttcgatataaaggagaaggaaaatgaacatcgggaatatagaatatacttcataaaagaaaattctatatattcgttcgatacaaaatctaaacaaactcgtagctcgcaagtcgatgcgcgactattttcagtaatggtaacttcgaaaccgttatttatagcagatatagggataggagtaggaatgccacaaatgaaaaaaatacttaaaatgtaatcttaatcgagtacaccgcacgacaatgaacaaacataagacagattatgctggttatgcttgctgcgtaatatgcggtctaattgttggaattatttttacagcgacactattaaaagttgtagaacgtaaattagttcatacaccatcaatagataaaacgataaaagatgcatatattagagaagattgtcctactgactggataagctataataataaatgtatccatttatctactgatcgaaaaacctgggaggaaggacgtaatgcatgcaaagctctaaatccaaattcggatctaattaagatagagactccaaacgagttaagttttttaagaagcattagacgcggatattgggtaggagaatccgaaatattaaaccagacaaccccatataattttatagctaaaaatgccacgaagaatggaactaaaaaacggaaatatatttgtagtacaacgaatactcccaaactacatttttatcataccactacttcggttagatgttttagaaaaaaataaatatcgccgtaccgttcttgtttttataaaaataacaattaacaattatcaaattttttctttaatattttacgtggttgaccattcttggtggtaaaataatctcttagtgttggaatggaatgctgtttaatgtttccgcactcatcgtatattttgacgtatgcagtcacatcgtttacgcaatagtcagactgtagttctatcatgcttcctacatcagaaggaggaacagttttaaagtctcttggttttaatctattgccattagttttcatgaaatcctttgttttatccacttcacattttaaataaatgtccactatacattcttctgttaattttactagatcgtcatgggtcatagaatttataggttccgtagtccatggatccaaactagcaaacttcgcgtatacggtatcgcgattagtgtatacaccaactgtatgaaaattaagaaaacagtttaataaatcaacagaaatatttaatcctccgtttgatacagatgcgccatatttatggatttcggattcacacgttgtttgtctgaggtgttcgtctagtgttgcttctacgtaaacttcgattcccatatattctttattgtcagaatcgcataccgatttatcatcatacactgtttgaaaactaaatggtatacacatcaaaataataaataataacgagtacattctgcaatattgttatcgtaattggaaaaatagtgttcgagtgagttggattatgtgagtattggattgtatattttattttatattttatattttgtagtaagaatagaatgctaatgtcaagtttattccaatagatgtcttattaaaaaacatatataataaataacaatggctgaatggcataaaattatcgaggatatctcaaaaaataataagttcgaggatgccgccatcgttgattacaagactacaaagaatgttctagctgctattcctaacagaacatttgccaagattaatcctctcatcactaatcgtaatattctaaaacctcttattggtcagaaatattgtattgtatatactaactctctaatggatgagaacacgtatgctatggagttgcttactgggtacgcccctgtatctccgatcgttatagcgagaactcataccgcacttatatttttgatgggtaagccaacaacatccagacgtgacgtgtatagaacgtgtagagatcacgctacccgtgtacgtgcaactggtaattaaaataaaaagtaatattcatatgtagtgtcaattttaaatgatgatgatgaaatggataatatccatattgacgatgtcaataatgccggtattggcatacagttcatcgatttttagatttcattcagaggatgtggaattatgttatgggcatttgtattttgataggatctataatgtagtaaatataaaatataatccgcatattccatatagatataattttattaatcgcacgttaaccgtagatgaactagacgataatgtcttttttacacatggttattttttaaaacacaaatatggttcacttaatcctagtttgattgtctcattatcaggaaacttaaaatataatgatatacaatgctcagtaaatgtatcgtgtctcattaaaaatttggcaacgagtacatctactatattaacatctaaacataagacttattctctacatcggtccacgtgtattactataataggatacgattctattatatggtataaagatataaatgacatctatgattttactgcaatatgtatgctaatagcgtctacattgatagtgaccatatacgtgtttaaaaaaataaaaatgaactcttaattatgctatgctattagaaatggataaaatcaaaattacggttgattcaaaaattggtaatgttgttaccatatcgtataacttggaaaagataactattgatgtcacacctaaaaagaaaaaagaaaaggatgtattattagcgcaatcagttgctgtcgaagaggcaaaagatgtcaaggtagaagaaaaaaatattatcgatattgaagatgacgatgatatggatgtagaaagcgcataatacgatctataaaaataagtatataaatactttttatttactgtactcttactgtgtagtggtgataccctactcgattatttttttaaaaaaaaatacttattctgattcttctagccatttccgtgttcgttcgaatgccacatcgacgttaaagataggggagtagttgaaatctagttctgcattgttggtacgcacctcaaatgtagtgttggatatcttcaacgtatagttgttgagtagtgatggttttctaaatagaattctcttcatatcattcttgcacgcgtacatttttagcatccatcttggaatcctagatccttgttctattcccaatggtttcatcaatagaagattaaacatatcgtacgaacacgatggagagtaatcgtagcaaaagtaagcatttcctttaatctcagatcccggatactggatatattttgcagccaacacgtgcatccatgcagcatttcctacatatacccggctatgtaccgcgttatcatcgactgtacgatacataatgttaccgtgttgcttacattgctcgtaaaagactttcatcaatttgtctccttctccgtaaattccagtgggtcttaggcaacaagtatacaattttgctccattcatgattacggaattattggctttcataaccagttgctcggccatacgtttactttttgcgtatacatgtcctggtgatatatcataaagggtatgctcatggccgatgaatggatcaccgtgtttattgggtcctattgcttccatgctactagtatagatcaaatacttgattcctaggtccacacaagctgccaatatagtctgtgttccataatagtttactttcatgatttcattatcggtgtattttccaaatacatccactagagcagctgtatgaataatcagatttaccccatctagcgcttctcttaccttatcaaagtcgtttatatcacattgtatatagtttataaccttaactttcgaggttattggttgtggatcttctacaatatctatgactctgatttcttgaacatcatctgcactaattaacagttttactatatacctgcctagaaatccggcaccaccagtaaccgcgtacacggccattgctgccactcataatatcagactacttattctattttactaaataatggctgtttgtataatagaccacgataatatcagaggagttatttactttgaaccagtccatggaaaagataaagttattggattaaaatccggaacgtatagtttgataattcatcgttacggagatattagtcaaggatgtgattccataggcagtccagaaatatttatcggtaacatctttgtaaacagatatggtgtagcatatgtttatttagatacagatgtaaatatatctacaattattggaaaggcgttatctatttcaaaaaatgatcagagattagcgtgtggagttattggtatttcttacataaatgaaaagataatacattttcttacaattaacgagaatggcgtttgatatatcagttaatgcgtctaaaacaataaatgcattagtttacttttctactcagcaaaataaattagtcatacgtaatgaagttaatgatacacactacactgtcgaatttgatagggacaaagtagttgacacgtttatttcatataatagacataatgactccatagagataagaggggtgcttccagaggaaactaatattggttgcgcggttaatacgccggttagtatgacttacttgtataataagtatagttttaaactgattttagcagaatatataagacacagaaatactatatccggcaatatttattcggcattgatgacactagatgatttggctattaaacagtatggagacattgatctattatttaatgagaaacttaaagtagactccgattcgggactatttgactttgtcaactttgtaaaggatatgatatgttgtgattctagaatagtagtagctctatctagtctagtatctaaacattgggaattgacaaataaaaaatataggtgtatggcattagccgaacatatatctgatagtattccaatatctgagctatctagactacgatacaatctatgtaagtatctacgcgggcacactgagagcatagaggatgaatttgattattttgaagacgatgattcgtctacatgttctgccgtaaccgacagggaaacggatgtataattttttttatagcgtgaaggatatgataaaaaatataattgttgtatttatcccattccaatcaccttatatgattctgtaacacaatgaaggagtcttatagatgtatagaggtcagatactggtttgataaactgtttattccacataagtatgtttgactttatggttagacccgcatactttaacaaatcactgaaaattggagttaggtattgacctctcagaatcagttgccgttctggaacattaaatgtattttttatgatatactccaacgcatttatgtgggcatacaacaagtcattactaatggagtattccaagagaagagatttcaacagactgtttatgaactcgaatgccgcctcattgtcgcttatattgatgatgtcgaattctcccaatatcatcaccgatgagtagctcatcttgttatcgggatccaagttttctaaagatgtcattaaaccctcgatcatgaatggatttatcatcatcgtttttatgttggacatgagcttagtccgtttgtccacatctatagacgacgatttctgaattatttcatatatccctctctttaactccaggaacttgtcaggatggtctactttaatatgttctcgtctaagagatgaaaatctttggatggttgcacgcgacttttctctaaaggatcctctcttaaatgaatccatcttatccttggacaagatggacagtctattttccttagatggtttaatatttttgttacccatgatctataaaggtagacctaatcgtctcggatgaccatatatttattttcagttttattatacgcataaattgtaaaaaatatgttaggtttacaaaaatgtctcgtggggcattaatcgtttttgaaggattggacaaatctggaaaaacaacacaatgtatgaacatcatggaatctataccggcaaacacgataaaatatcttaactttcctcagagatccactgtcactggaaagatgatagatgactatctaactcgtaaaaaaacctataatgatcatatagttaatctattattttgtgcaaatagatgggagtttgcatcttttatacaagaacaactagaacagggaattactttaatagttgatagatacgcattctctggagtagcgtatgccgccgctaaaggcgcgtcaatgactctcagtaagagttatgaatctggattgcctaaacccgacttagttatattcttggaatctggtagcaaagaaattaatagaaacgtcggcgaggaaatttatgaagatgttacattccaacaaaaggtattacaagaatataaaaaaatgattgaagaaggagatattcattggcaaattatttcttctgaattcgaggaagatgtaaagaaggagttgattaagaatatagttatagaggctatacacacggttactggaccagtggggcaactgtggatgtaatagtgaaattacattttttataaatggatgaagcatattactctggcaacttggaatcagtactcggatacgtgtccgatatgcataccgaactcgcatcaatatctcaattagttattgccaagatagaaactatagataatgatatattaaacaaggacattgtaaattttatcatgtgtagatcaaacttggataatccatttatctctttcctagatactgtatatactattatagatcaagagatctatcagaccgaattgattaattcattagacgacaatgaaattatcgattgtatagttaacaagtttatgagcttttataaggataacctagaaaatatagtagatgctatcattactctaaaatatataatgaataatccagattttaaaactacgtatgccgaagtactcggttccagaatagcggatatagatattaaacaagtgatacgtgagaatatactacaattgtctaataatatccgcgaacgatatttgtgaaaatattaaaaaaaaatactttttttattaaatgacgtcgcttcgcgaatttagaaaattatgctgtgatatatatcacgcatcaggatataaagaaaaatctaaattaattagagactttataacagatagggatgataaatatttgatcattaagctattgcttcccggattagacgatagaatttataacatgaacgataaacaaattataaaattatatagtataatatttaaacaatctcaggaagatatgctacaagatttaggatacggatatataggagacactattaggactttcttcaaagagaacacagaaatccgtccacgagataaaagcattttaactttagaagaagtggatagttttttaactacgttatcatccgtaactaaagaatcgcatcaaataaaattattgactgatatcgcatccgtttgtacatgtaatgatttaaaatgtgtagtcatgcttattgataaagatctaaaaattaaagcgggccctcggtacgtacttaacgctattagtcctcatgcctatgatgtgtttagaaaatctaataacttgaaagagataatagaaaatgcatctaaacaaaatctagactctatatctatttctgttatgactccaattaatcccatgttagcggaatcgtgtgattctgtcaataaggcgtttaaaaaatttccatcaggaatgtttgcggaagtcaaatacgatggtgaaagagtacaagttcataaaaataataacgagtttgccttctttagtagaaacatgaaaccagtactctctcataaagtggattatctcaaagaatacataccgaaagcatttaaaaaagctacgtctatcgtattggattctgaaattgttcttgtagacgaacataatgtaccgctcccgtttggaagtttaggtatacacaaaaagaaagaatataaaaactctaacatgtgtttgttcgtgtttgactgtttgtactttgatggattcgatatgacggacattccattgtacgaacgaagatcttttctcaaagatgttatggttgaaatacccaatagaatagtattctcagagttgacgaatattagtaacgagtctcagttaactgacgtattggatgatgcactaacgagaaaattagaaggattggtcttaaaagatattaatggagtatacgaaccgggaaagagaagatggttaaaaataaagcgagactatttgaacgagggttccatggcagattctgccgatttagtagtactaggtgcttactatggtaaaggagcaaagggtggtatcatggcagtctttctaatgggttgttacgacgatgaatccggtaaatggaagacggttaccaagtgttcaggacacgatgataatacgttaagggagttgcaagaccaattaaagatgattaaaattaacaaggatcccaaaaaaattccagagtggttagtagttaataaaatctatattcccgattttgtagtagaggatccaaaacaatctcagatatgggaaatttcaggagcagagtttacatcttccaagtcccataccgcaaatggaatatccattagatttcctagatttactaggataagagaggataaaacgtggaaagaatctactcatctaaacgatttagtaaacttgactaaatcttaatagttacatacaaattaaaataacactatttagttggtggtcgccatggatggtgttattgtatactgtctaaacgcgttagtaaaacatggcgaggaaataaatcatataaaaaatgatttcatgattaaaccatgttgtgaaaaagtcaagaacgttcacattggcggacaatctaaaaacaatacagtgattgcagatttgccatatatggataatgcggtatccgatgtatgcaattcactgtataaaaagaatgtatcaagaatatccagatttgctaatttgataaagatagatgacgatgacaagactcctactggtgtatataattattttaaacctaaagatgccattcctgttattatatccataggaaaggatagagatgtttgtgaactattaatctcatctgataaagcgtgtgcgtgtatagagttaaattcatataaagtagccattcttcccatggatgtttccttttttaccaaaggaaatgcatcattgattattctcctgtttgatttctctatcgatgcggcacctctcttaagaagtgtaaccgataataatgttattatatctagacaccagcgtctacatgacgagcttccgagttccaattggttcaagttttacataagtataaagtccgactattgttctatattatatatggttgttgatggatctgtgatgcatgcaatagctgataatagaacttacgcaaatattagcaaaaatatattagacaatactacaattaacgatgagtgtagatgctgttattttgaaccacagattaggattcttgatagagatgagatgctcaatggatcatcgtgtgatatgaacagacattgtattatgatgaatttacctgatgtaggcgaatttggatctagtatgttggggaaatatgaacctgacatgattaagattgctctttcggtggctggtatttggaaagttttataggtagttgatagaacaaaatacataattttgtaaaaataaatcactttttatactaatatgacacgattaccaatacttttgttactaatatcattagtatacgctacaccttttcctcagacatctaaaaaaataggtgatgatgcaactttatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcgcctacaaatgacactgataaagtagattatgaagaatactccacagagttgattgtaaatacagatagtgaatcgactatagacataatactatctggatctacacattcaccggaaactagttctgagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagaagatcatacagttacagacactgtctcatacactacagtaagtacatcatctggaattgtcactactaaatcaaccaccgatgatgcggatctttatgatacgtacaatgataatgatacagtaccatcaactactgtaggcggtagtacaacctctattagcaattataaaaccaaggactttgtagaaatatttggtattaccgcattaattatattgtcggccgtggcaatattctgtattacatattatatatataataaacgttcacgtaaatacaaaacagagaacaaagtctagatttttgacttacataaatgtctgggatagtaaaatctatcatattgagcgggccatctggtttaggaaagacagccatagccaaaagactatgggaatatatttggatttgtggtgtcccataccactagatttcctcgtcctatggaacgagaaggtgtcgattaccattacgttaacagagaggccatctggaagggaatagccgccggaacatactgagtttttaggaaatatttacggaacttctaaaactgctgtgaatacagcggctattaataatcgtatttgtgtgatggatctaaacatcgacggtgttagaagttttaaaaatacttacctaatgccttactcggtgtatataagacctacctctcttaaaatggttgagaccaagcttcgttgtagaaacactgaagcggatgatgagattcatcgtcgtgtgatgttggcaaaaactgacatggatgaggcaggtgaagccggtctattcgacactattatcattgaagatgatgtgaatttagcatatagtaagttaattcagatactacaggaccgtattagaatgtattttaacactaattagagacttaagacttaaaacttgataattaataatataactcgtttttatatgtggctatttcaacgtctaatgtattagttaaatattaaaacttaccacgtaaaacttaaaatttaaaatgatatttcattgacagatagatcacacattatgaactttcaaggacttgtgttaactgacaattgcaaaaatcaatgggtcgttggaccattaataggaaaaggtggatttggtagtatttatactactaatgacaataattatgtagtaaaaatagagcccaaagctaacggatcattatttaccgaacaggcattttatactagagtacttaaaccatccgttatcgaagaatggaaaaaatctcacaatataaagcacgtaggtcttatcacgtgcaaggcatttggtctatacaaatccattaatgtggaatatcgattcttggtaattaatagattaggtgcagatctagatgcggtgatcagagccaataataatagattaccaaaaaggtcggtgatgttgatcggaatcgaaatcttaaataccatacaatttatgcacgagcaaggatattctcacggagatattaaagcgagtaatatagtcttggatcaaatagataagaataaattatatctagtggattacggattggtttctaaattcatgtctaatggcgaacatgttccatttataagaaatccaaataaaatggataacggtactctagaatttacacctatagattcgcataaaggatacgttgtatctagacgtggagatctagaaacacttggatattgtatgattagatggttgggaggtatcttgccatggactaagatatctgaaacaaagaattgtgcattagtaagtgccacaaaacagaaatatgttaacaatactgcgactttgttaatgaccagtttgcaatatgcacctagagaattgctgcaatatattaccatggtaaactctttgacatattttgaggaacccaattacgacaagtttcggcacatattaatgcagggtgtatattattaagtgtggtgtttggttgatgtaaaatttttgtcgataaaaattaaaaaataacttaatttattattgatctcgtgtgtacaaccgaaatcatggcgatgttttacgcacacgctctcggtgggtacgacgagaatcttcatgcctttcctggaatatcatcgactgttgccaatgatgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcacatatcgccacaaaaactactatgctctaagcggaatcgggtacgagagtctagacttgtgtttggaaggagtagggattcatcatcacgtacttgaaacagaaaacgctgtatatggaaaagttcaacatgattattctactatcaaagagaaggccaaagaaatgaatgcactcagttcaggacctatcatcgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaaccacctctctggaagacagtgtgaatcatgtactcatgaaacgtttggaatctatacgccatatgtggtctgttgtatatgatcattttgatattgtgaatggtaaagaatgctgttatgtgcatacgcatttgtctaatcaaaatcttataccgagtactgtaaaaacaaatttgtacatgaagactatgggatcatgcattcaaatgagtatcttagcgaactgaaggaatcaggtggatggagtcccagaccagaaatgcaggaatttgaatatccagatggagtggaagacactgaatcaattgagagattggtagaggagttcttcaatagatcagaacttcaggctggtaaatctattaatgttaaacatacatctgtttcagctaagcaactaagaacacgtatactctcatcttttgccaacacagagggtggatatttgttcattggagttgataataatacacacaaagtatttggattcacggtgggttacgactacctcagactgatagagaatgatatagaaaagcatatcaaaagactttgtgttgtgtatttctgtgagaagaaagaggacatcaagtacacgtgtcgattcatcaaggtatataaacctggggatgaggctacctcgacatacgtgtgcgctatcaaagtggaaagatgctgttgtgctgtgtttgcagattggccagaatcatggtatcaagaagtattctccagatgaataggtgtcacatataaaattttaattaatgtaactatagagaacaaataataggttgtaatatcatatagacaataactaacaattaattagtaactgttatctctttttaactaactaactatacctattaatacatcgtaattatagttcttaacatctattaatcattgattcgcttctttaattttttataaaccaacattgttaattgaaaagggataacatgttacagaatataaattatatatggattttttttaaaaaggaaatacttgactggagtgtatatttatctcttcattatatagcacgcgtgttttccaatttttccacatcccatataatacaggattataatctcgttcgaacatacgagaaagtggataaaacaatagttgattttttatctaggttgccaaatttattccatattttagaatatggggaaaatattctacatatttattctatggatgatgctaatacgaatattataattttttttctagatagagtattaaatattaataagaacgggtcatttatacacaatctcaggttatcatcatccattaatataaaagaatatgtatatcaattagttaataatgatcatccagataataggataagactaatgcttgaaaatggacgtagaacaagacattttttgtcctatatatcagatacagttaatatctatatatgtattttatatagatgccgaagacagttacggttgtacattattacatagatgtatatatcactataagaaatcagaatcagaatcagaatcatacaatgaattaattaagatattgttaaataatggatcagatgtagataaaaaagatacgtacggaaacacaccttttatcctattatgtaaacacgatatcaacaacgtggaattgtttgagatatgtttagagaatgctaatatagactctgtagactttaatagatatacacctcttcattatgtctcatgtcgtaataaatatgattttgtaaagttattaatttctaaaggagcaaatgttaatgcgcgtaataaattcggaactactccattttattgtggaattatacacggtatctcgcttataaaactatatttggaatcagacacagagttagaaatagataatgaacatatagttcgtcatttaataatttttgatgctgttgaatctttagattatctattatccagaggagttattgatattaactatcgtactatttacgacgctgtcagttataatgcgtataatacgttggtctatctattaaacagaaatggtgattttgagacgattactactagtggatgtacatgtatttcggaagcagtcgcaaacaacaacaaaataataatggaagtactattgtctaaacgaccatctttgaaaattatgatacagtctatgatagcaattactaaacataaacagcataatgcagatttattgaaaatgtgtataaaatatactgcgtgtatgaccgattatgatactcttatagatgtacaatcactacagcaatataaatggtatattttaagatgtttcgatgaaatagatatcatgaagagatgttatataaaaaataaaactgtattccaattagttttttgtatcaaagacattaatactttaatgagatacggtaaacatccttctttcgtgaagtgcactagtctcgacgtatacggaagtcgtgtacgtaatatcatagcatctattagatatcgtcagagattaattagtctattatccaagaagctggatcctggagataaatggtcgtgttttcctaacgaaataaaatataacgataacgaactgtccacatatctaaaaatcttataaacactattaaaatataaaatcacactacatcattgtttccttttagtgctcgacagtgtatactatttttaacgctcataaataaaaatgaaaacgatttccgttgttacgttgttatgcgtactacctgctgttgtttattcaacatgtactgtacccactatgaataacgctaaattaacgtctaccgaaacatcgtttaataataaccagaaagttacgtttacatgtgatcagggatatcattcttcggatccaaatgctgtctgcgaaacagataaatggaaatacgaaaatccatgcaaaaaaatgtgcacagtttctgattacatctctgaactatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatataactatcaactgtgatgttggatatgaggttattggtgcttcgtacataagttgtacagctaattcttggaatgttattccatcatgtcaacaaaaatgtgatataccgtctctatctaatggattaatttccggatctacattttctatcggtggcgttatacatcttagttgtaaaagtggttttatactaacgggatctccatcatccacatgtatcgacggtaaatggaatcccatactcccaacatgtgtacgatctaacgaaaaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtgaatataaatccgttaaaataatgaataattaataattaataatttaataacaaacaagtatcaaaagattaaagacttatagctagaatcaattgagatgtcttcttcagtggatgttgatatctacgatgccgttagagcatttttactcaggcactattataacaagagatttattgtgtatggaagaagtaacgccatattacataatatatacaggctatttacaagatgcgccgttataccgttcgatgatatagtacgtactatgccaaatgaatcacgtgttaaacaatgggtgatggatacacttaatggtataatgatgaatgaacgcgatgtttctgtaagcgttggcaccggaatactattcatggaaatgtttttcgattacaataaaaatagtatcaacaatcaactaatgtatgatataattaatagcgtatctataattctagctaatgagagatatagaagcgcttttaacgacgatggtatatacatccgtagaaatatgattaacaagttgtacggatacgcatctctaactactattggcacgatcgctggaggtgtttgttattatctgttgatgcatctagttagtttgtataaataattatttcaatatactagttaaaattttaagattttaaatgtataaaaaactaataacgtttttatttgtaataggtgcattagcatcctattcgaataatgagtacactccgtttaataaactgagtgtaaaactctatatagatggagtagataatatagaaaattcatatactgatgataataatgaattggtgttaaattttaaagagtacacaatttctattattacagagtcatgcgacgtcggatttgattccatagatatagatgttataaacgactataaaattattgatatgtctactattcaacgcagaggtcacacgtgtagaatatctaccaaattatcatgccattatgataagtacccttatattcacaaatatgatggtgatgagcgacaatattctattactgcagagggaaaatgctataaaggaataaaatatgaaataagtatgatcaacgatgatactctattgagaaaacatactcttaaaattggatctacttatatatttgatcgtcatggacatagtaatacatattattcaaaatatgatttttaaaaatttaaaatatattatcacttcagtgacagtagtcaaataacaaacaacaccatgagatatattataattctcgcagttttgttcattaatagtatacacgctaaaataactagttataagtttgaatccgtcaattttgattccaaaattgaatggactggggatggtctatacaatatatcccttaaaaattatggcatcaagacgtggcaaacaatgtatacaaatgtaccagaaggaacatacgacatatccgcatttccaaagaatgatttcgtatctttctgggttaaatttgaacaaggcgattataaagtggaagagtattgtacgggaccaccgactgtaacattaactgaatacgacgaccatccgtatgctactagaggtagcaaaaagattcctatttacaaacgcggtgacatgtgtgatatctacttgttgtatacggctaacttcacattcggagattctaaagaaccagtaccatatgatatcgatgactacgattgcacgtctacaggttgcagcatagactttgtcacaacagaaaaagtgtgcgtgacagcacagggagccacagaagggtttctcgaaaaaattactccatggagttcgaaagtatgtctgacacctaaaaagagtgtatatacatgcgcaattagatccaaagaagatgttcccaatttcaaggacaaaatggccagagttatcaagagaaaatttaactaaatttctcggtagcacatcaaatgatgttaccacttttcttagcatgcttaacttgactaaatattcataactaatttttattaatgatacaaaaacgaaataaaactgcatattatacactggttaacgcccttataggctctaaccattttcaagatgaggtccctgattatagtccttctgttcccctctatcatctactccatgtctattagacgatgtgagaagactgaagaggaaacatggggattgaaaatagggttgtgtataattgccaaagatttctatcccgaaagaactgattgcagtgttcatctcccaactgcaagtgaaggcaatggattcagggatatacgaaacaccgataaattataaaaaaagcaatgtgtccgctgtttccgttaataatactattttcgtaactggcggattattcataaataactctaatagcacgatcgtggttaacaatatggaaaaacttgacatttataaagacaaacaatggtcgattatagaaatgcctatggctagggtatatcacggcatcgactcgacatttggaatgttatattttgccggaggtctatccgttaccgaacaatatggtaatttagagaaaaacaacgagatatcttgttacaatcctagaacgaataagtggtttgatatttcatatactatttataagatatccatatcatcattgtgtaaactaaataacgtcttctatgtatttagtaaggacattggatatgtggaaaagtatgatggtctccccgctataaaggcattatcaacttctccttattgattgaaaatgaaaatataaatagtttttatgtatagcagtattaccctatagttttattgcttactactaacatggatacagatacagatgttacaaatgtagaagatatcatgaatgaaatagatagagagaaagaagaaatactaaaaaatgtagaaattgaaaataataaaaacattaacaagaatcatcccaatgaatatattagagaagcactcgttattaatacaagtagtaatagtgattccattgataaagaagttatagaatgtatcagtcacgatgtaggaatatagatcatatctactaatttttataatcaatacaaaacataaaaaacaactcgttattacatagcaggcatggaatccttcaagtattgttttgataacgatggcaagaaatggattatcggaaatactttatattctggtaattcaatactctataaggtcagaaaaaatttcactagttcgttctacaattacgtaatgaagatagatcacaaatcacacaagccattgttgtctgaaatacgattctatatatctgtattggatcctttgactatcgacaactggacacgggaacgtggtataaagtatttggctattccagatctgtatggaattggagaaaccgatgattatatgttcttcgttataaagaatttgggaagagtattcgccccaaaggatactgaatcagtcttcgaagcatgcgtcactatgataaacacgttagagtttatacactctcgaggatttacccatggaaaaatagaaccgaggaatatactgattagaaataaacgtctttcactaattgactattctagaactaacaaactatacaagagtggaaactcacatatagattacaacgaggacatgataacttcaggaaatatcaattatatgtgtgtagacaatcatcttggagcaacagtttcaaaacgaggagatttagaaatgttgggatattgcatgatagaatggttcggtggcaaacttccatggaaaaacgaaagtagtataaaagtaataaaacaaaaaaaagaatataaaaaatttatagctactttctttgaggactgttttcctgaaggaaatgaacctctggaattagttagatatatagaattagtatacacgttagattattctcaaactcctaattatgacagactacgtagactgtttatacaagattgaaatattctttttttatagagtgtggtagtgttacggatatctaatattaatattagactatctctatcgcgctacacgaccaatatcgattactatggatatcttctatgaaaggagagaatgtattcatttctccagcgtcaatctcgtcagtattgacaatactgtattatggagctaatggatccactgctgaacagctatcaaaatatgtagaaaaggaggagaacacggataaggttagcgctcagaatatctcattcaaatccatgaataaagtatatgggcgatattctgccgtgtttaaagattcctttttgagaaaaattggcgataagtttcaaactgttgacttcactgattgtcgcactatagatgcaatcaacaagtgtgtagatatctttactgaggggaaaatcaatccactattggatgaacaattgtctcctagcaattagtgccgtatactttaaagcaaaatggttgacgccattcgaaaaggaatttaccagtgattatcccttttacgtatcaccaacggaaatggtagacgtaagtatgatgtctatgtacggcgagctatttaatcacgcatctgtaaaagaatcattcggtaacttttcaatcatagaactgccatatgttggagatactagtatgatggtcattcttccagacaagattgatggattagaatccatagaacaaaatctaacagatacaaattttaagaaatggtgtaactctctggaagctacgtttatcgatgttcacattcccaagtttaaggtaacaggctcgtataatctggtggatactctagtaaagtcaggactgacagaggtgttcggttcaactggagattatagcaatatgtgtaatttagatgtgagtgtcgacgctatgatccacaaaacgtatatagatgtcaatgaagagtatacagaagcagctgcagcaacttgtgcactggtgtcagactgtgcatcaacaattacaaatgagttctgtgtagatcatccgttcatctatgtgattaggcatgttgatggaaaaatttttttcgttggtagatattgctctccgacaactaattgttaaccattttttttaaaaaaatagaaaaaacatgtggtattagtgcaggtcgttattcttccaattgcaattggtaagatgacggccaactttagtacccacgtcttttcaccacagcactgtggatgtgacagactgaccagtattgatgacgtcaaacaatgtttgactgaatatatttattggtcgtcctatgcataccgcaacaggcaatgcgctggacaattgtattccacactcctctcttttagagatgatgcggaattagtgttcatcgacattcgcgagctggtaaaaaatatgccgtgggatgatgtcaaagattgtgtagaaatcatccgttgttatataccggatgagcaaaaaaccatcatcggactttgtgcatatgctgctacttactggggaggtgaagaccatcccactagtaacagtctgaacgcattgtttgtgatgcttgagatgctaaattacgtggattataacatcatattccggcgtatgaattgatgagttgtacatcttgacattttcttctttcttctcttctccctttcccagaaacaaactttttttacccactataaaataaaatgagtatactacctgttatatttctttctatatttttttattcttcattcgttcagacttttaacgcgcctgaatgtatcgacaaagggcaatattttgcatcattcatggagttagaaaacgagccagtaatcttaccatgtcctcaaataaatacgctatcatccggatataatatattagatattttatgggaaaaacgaggagcggataatgatagaattataccgatagataatggtagcaatatgctaattctgaacccgacacaatcagactctggtatttatatatgcattaccacgaacgaaacctactgtgacatgatgtcgttaaatttgacaatcgtgtctgtctcagaatcaaatatagatcttatctcgtatccacaaatagtaaatgagagatctactggcgaaatggtatgtcccaatattaatgcatttattgctagtaacgtaaacgcagatattatatggagcgggcatcgacgccttagaaataagagacttaaacaacggacacctggaattattaccatagaagatgttagaaaaaatgatgctggttattatacatgtgttttagaatatatatacggtggcaaaacatataacgtaaccagaattgtaaaattagaggtacgggataaaataataccttctactatgcaattaccagaaggtgttgtaacttcaataggtagtaatttgactattgcgtgtagagtatcgttgagacctcccacaacggatgcagacgtcttttggataagtaatggtatgtattacgaagaagatgatggggacggagacggtagaataagtgtagcaaataaaatctatatgaccgataagagacgtgttattacatcccggttaaacattaatcctgtcaaggaagaagatgctacaacgtttacgtgtatggcgtttactattcctagcatcagcaaaacagttactgttagtataacgtgaatgtatgttgttacatttccatgtcaattgagtttataagaatttttatacattatcttccaacaaacaattgacgaacgtattgctatgattaactcccacgatactatgcatattattaatcattaacttgcagactatacctagtgctattttgacatactcatgttcttgtgtaattgcggtatctatattattaaagtacgtaaatctagctatagttttattatttaattttagataatataccgtctccttatttttaaaaattgccacatcctttattaaatcatgaatgggaatttctatgtcatcgttaatatattgtgaacaacaagagcagatatctataggaaagggtggaatgcgatacattgatctatgtagttttaaaacacacgcgaactttgaagaatttatataaatcattccatcgatacatccttctatgttgacatgtatatatccaggaattcttttattaatgtcaggaaatgtataaactaaaacattgcccgaaagcggtgcctctatctgcgttatatccgttcttaacttacaaaatgtaaccaatacctttgcatgacttgttttgttcggcaacgttagtttaaacttgacgaatggattaattacaatagcatgatccgcgcatctattaagtttttttactttaacgcccttgtatgtttttacagagactttatctaaatttctagtgcttgtatgtgttataaatataacgggatatagaactgaatcacctaccttagatacccaattacattttatcagatccagataataaacaaattttgtcgccctaactaattctatattgttatatattttacaattggttatgatatcatgtaataacttggagtctaacgcgcatcgtcgtacgtttatacaattgtgatttagtgtagtatatctacacatgtatttttccgcactatagtattctggactagtgataaaactatcgttatatctgtcttcaatgaactcatcgagatattgctctctgtcatattcatacacctgcataaactttctagacatcttacaatccgtgttattttaggatcatatttacatatttacgggtatatcaaagatgttagattagttaatgggaatcgtctataataatgaatattaaacaattatatgaggacttttaccacaaagcatcataaaaatgagtcgtcgtctgatttatgttttaaatatcaaccgcgaatcaactcataaaatacaagagaatgaaatatatacatattttagtcattgcaatatagaccatacttctacagaacttgattttgtagttaaaaactatgatctaaacagacgacaacctgtaactgggtatactgcactacactgctatttgtataataattactttacaaacgatgtactgaagatattattaaatcatggagtggatgtaacgatgaaaaccagtagcggacgtatgcctgtttatatattgcttactagatgttgtaatatttcacatgatgtagtgatagatatgatagacaaagataaaaaccacttatcgcatagagactattccaacctactactagagtatataaaatctcgttacatgttattgaaggaagaggatatcgatgagaacatagtatccactttattagataagggaatcgatcctaactttaaacaagacggatatacagcgttacattattattatttgtgtctcgcacacgtttataaaccaggtgagtgtagaaaaccgataacgataaaaaaggccaagcgaattatttctttgtttatacaacatggagctaatctaaacgcgttagataattgtggtaatacaccattccatttgtatcttagtattgaaatgtgtaataatattcatatgactaaaatgctgttgacttttaatccgaatttcaaaatatgtaataatcatggattaacgcctatactatgttatataacttccgactacatacaacacgatattcttgttatgttaatacatcactatgaaacaaatgttggagaaatgccgatagatgagcgtcgtataatcgtattcgagtttatcaaaacatattctacacgtccggcagattcgataacttatttgatgaataggtttaaaaatatagatatttatacccgctatgaaggaaagacattattacacgtagcatgtgaatataataatacacacgtaatagattatcttatacgtatcaacggagatataaatgcgttaaccgacaataacaaacacgctacacaactcattatagataacaaagaaaattccccatataccattaattgtttactgtatatacttagatatattgtagataagaatgtgataagatcgttggtggatcaacttccatctctacctatcttcgatataaaatcatttgagaaattcatatcctactgtatacttttagatgacacattttacaatagacacgttaggaatcgcaattctaaaacgtatcgatacgcattttcaaaatacatgtcgtttgataaatacgatggtataataactaaatgtcataaagaaacaatattgctcaaactatccactgttctagacactacactatatgcagttttaagatgccataattcgaaaaagttaagaagatacctcaacgagttaaaaaaatataataacgataagtcctttaaaatatattctaatattatgaatgagagataccttaatgtatattataaagatatgtacgtgtcaaaggtatatgataaactatttcctgttttcacagataaaaattgtctactaacattactaccttcagaaattatatacgaaatattatacatgctgacaattaacgatctttataatatatcgtatccacctaccaaagtatagttgtatttttctcatgcgatgtgtgtaaaaaaactgatattatataaatattttagtgccgtataatgaagatgacgatgaaaatgatggtacatatatatttcgtatcattattgttattgctattccacagttacgccatagacatcgaaaatgaaatcacagaattcttcaataaaatgagagatactctaccagctaaagactctaaatggttgaatccagcatgtatgttcggaggcacaatgaatgatatagccgctctaggagagccattcagcgcaaagtgtcctcctattgaagacagtcttttatcgcacagatataaagactatgtggttaaatgggagaggctagaaaaaaatagacggcgacaggtttctaataaacgtgttaaacatggtgatttatggatagccaactatacatctaaattcagtaaccgtaggtatttgtgtaccgtaactacaaagaatggtgactgtgttcagggtatagttagatctcatattaaaaaacctccttcatgcattccaaaaacatatgaactaggtactcatgataagtatggcatagacttatactgtggaattctttacgcaaaacattataataatataacttggtataaagataataaggaaattaatatcgacgatattaagtattcacaaacgggaaagaaattaattattcataatccagagttagaagatagtggaagatacaactgttacgttcattacgacgacgttagaatcaagatgtaaaatacttacggttataccgtcgcaagaccacaggtttaaactaatactagatccaaaaatcaacgtaacgataggagaacctgccaatataacatgcactgctgtgtcaacgtcattattgattgacgatgtactgattgaatgggaaaatccatccggatggcttataggattcgattttgatgtatactctgttttaactagtagaggcggtatcaccgaggcgaccttgtactttgaaaatgttactgaagaatatataggtaatacatataaatgtcgtggacacaactattattttgaaaaaacccttacaactacagtagtattggagtaaatacacaatgcatttttatatacattactgaataattattattattatttatatcgtatttgtgctataacgcgactatctaggtatttgtatctcaccgatagagaacatataaatgtagactctattaaacagttgtgtaaaatatcagatcctaatagatgtggatgtacggctttagaaatgagttcattaaaatatgtgatatcaacggaacatatttatataattatactattgctgttagtataattattgattccacggaagaactaccaacagttactccaattacaacaacatataattatactatcgatgatagcactactgaagaactacaagtgactcctcatatggatctccatcgatgatacatgtattaaaatactttccgaataagtcttttaaatattgtattaattatgaaaaactatgctatgcgagtatgatacgatactagattttatctctagcgagagatgtcgttagaatcatttatcaacgaatatcgataacatgtgtcatttatacgttaaagtctgtccgtcttctctattgtttagactgtttgtagaatgctgtgatataaacaaactagtagacacaaatatttaactcatgatgaagttgagaatgatatgctttagctaatataaaaatatattaatccactatatattctagacttgatttaaaaccgataaactactactacgtactgtataagttaggagcagaccctaattatgtagatgatagaggtaatacttctgcatctatatgtccacttatgagaaaacgtcatttaataagatgcatcgtgaaaagaaatttattaaagagttggtaaaatatgaaaccgaaagtaaataatataggaaatacacctctacataactacgtatctcaatatgatatcactctcattcctcatccacaacccattaaaaaatggaaattaaagccctctattagcataaacggctacaggtctacctttacaatggcctttccttgtgcccagttcagaccctgtcattgccacgctactaaggactccctgaataccgtggccgacgtcagacattgtctgactgaatacatcctgtgggtttctcatagatggacccatagagaaagcgcagggtctctctacaggcttctcatctctttcagaactgatgcaacggagctctttggtggtgagttgaaggattcacttccgtggagatcattaaatgactccatgaaaaccgccgaagaacttcgtgcaatcattggactttgtactcaatcagctatcgtctctggaagagtcttcaacgataagtatatcgacatactacttatgctgcgaaagattctgaacgagaacgactatctcaccctcttggatcatatccgcactgctaaatactaaatctccttcatgctctctcactacactttttatcatcttatgaggaataattagcaccagaatagctatggattgcacatgtattctatgtcgtctactggatgaagatgtgacgtacaaaaaaataaaactagaaattgaaacgtgtcacaacttatcaaaacatatagatagacgaggaaacaatgcgctacattgttacgtctccaataaatgcgatacagacattaagattgttcgactgttactctctcgcggagtcgagagactttgtagaaacaacgaaggattaactccgctaggagcatacagtaagcatagatacgtaaaatctcagattgtgcatctactgatatccagctattcgaattcctctaacgaactcaagtcgaatataaatgatttcgacttacgtctgctaaaatacctaattgtggataaacggatacgtccgtccaagaatacgaattatgcaatcaatggtctcggattggtggatatatacgtaacgacgcctaatccgagaccagaagtattgctatggcttcttaaatcagaatgttacagcaccggttacgtatttcgtacctgtatgtacaacagtgatatgtgtaagaactctcttcattactatatatcgtctcatagagaatctctatccaaggatgtaattaaatgtttgatcgataacaatgtttccatccaatactactggtcttgctcaaccatagatatagagattattaataaaggatgtggacacgtgtagagtatacgacgtcagccctatattagaggcgtattatctaaacaagcgatttagagtaaccccatataatgtagacatggaaatcgttaatcttcttattgagagacgtcatactcttgtcgacgtaatgcgtagtattacttcgtacgattccagagaatataaccactacatcatcgataacattctaaagagatttagacaacaggatgaatccatcgtacaagccatactgataaactacttacattacggcgatatggtaagtatacctatcattcaatgcatgttggataagacgacggacaacaactttgttaataataatctcgtcgatgtaaacgtcgtaaggtttatcgtggaaaatatggacacgcggctgtaaatcacatatctaacaatggccgtctatgtatgtacggtctgatattatcgagatttaataattgcgggtatcactgttatgaagatgtatttgatatactaagcaagtacatggatgatatagatatgatcgataactctactatattacgcggtcgatgtcaataatatacaatttgcaaagcggttattggaatatggagcgagtgtcacgctcgataatcaatacggccatccagaaaagcagttaccaaagagaagctagttgatttattactgagttaccatcccactctagagactatgattgacgcatttaatagagatatacgctatctatatcctgaaccattattcgcctgtatcagatacgccttaatcctagatgatgattttccttctaaagtaagtatgatatcgccggtcgtcataaggaactaaagcgctatagagcagacattaatagaatgaagaatgcctacatatcaggcgtctccatgtttgatatattatttaaacgaagcaaacgccacagattgagatacgcaaagaacaatgagaggatcgactccattaaataatttatcatggagtgataatgtcctgtttccatggcatattacaaaatcgattccgtccaagatgataaaaacatttaccggcatcataaacacggagtttattttatatgtctcgcataaacattactaaaaaaatatattgttcggttttctttcacatctttaattatgaaaaagtaaatcattatgagatggacgcatcgttcgcgacagtatgtggtacatacctaacgtatttatggacgacggtaagaatgaaggtcacgtttctgtcaacaatgtcgacgcgatcgtgtaacacgactcacaatagaatctgtgaatgctctcccgatcatggatgcaaggcatgtgtttcccaaacaaaatgtggaataggatacggagtatccggagacgtcatctgttctccgtgtggtctcggaacatattctcacaccgtctcttccgcagataaatgcgaacccgtacccagaaatacctttaactatatcgatgtggaaattaacctgtatccagttaacgacacatcgtgtactcggacgaccactaccggtctcagcgaatccatctcaacgtcggaactaactattactatgaatcataaagactgcgatcccgtcttcttaataaggtagcgacttcaggtttctttacaggagaaaggtgtgcactctgaatttcgagattaaatgcaataacaaagattcttcctccaaacagttaacgaaagcaaagaatgatactatcatgccgcattcggagacagtaactctagcgtcgacatctatatactatatagtaataccaatactcaagactacgaaactgatacaatctcttatcatgtgggtaatgtagccatatgcccggtagttgcgatatacataaactgatcactaattccaaacccacccgctttttatagtaagtttttcacccataaatacaataattaatttctcgtaaaagtagaaaatatattctaatttattgcacggtaaggaagtagaatcataaagaacagtactcaatcaatagcaatcatgaaacaatatatcgtactggcatgcatgtgcctgccagtcttcagcaatcatcctcatcgtgtacggaagaagaaaacaaacatcatatgggaatcgatgttattatcaaagtcacaaagcaagaccaaacaccgaccgatgataagatttgccaatccgtaacggaaattacagagtccgagtcagatccagatcccgaggtggaatcagtcgaggatgtagatcctcctaccacttattactccatcatcggtggaggtctgagaatgaactttggattcaccaaatgtcctcagattaaatccatctcagaatccgctgatggaaagactgtgaggtgtctatcgacatcagatgtagcgaagaagagaaagacagcgacatcaagacccatccagtactcgggtctaacatctctcataagaaagtgagttacgaagatatcatcggttcaacgatcgtcgatacaaaatgtgtcaagaatctagagtttagcgttcgtatcggagacatgtgcaaggaatcatctgaacttgaggtcaagtatgtcgacggatcggcatctgaaggtgcaaccgatgatacttcactcatcgattcaacaaaactcaaagcgtgtgtctgaatcgataactctattcatctgaaattggatgagtagggttaatcgaacgattcaggcacaccacgaattaaaaaagtgtaccggacactatattccggtttgcaaaacaaaaagttacctctcgcgacttcttctttttctgtctcaatagtgtgatacgattatgacactattcctatttcctttcagggtatcacaaaaatattaaacctctttctgatggtctcatacaaaaatatttttattctctttctctctttgatggtctcataaaaaatatttttattctctttctctctttgatggtctcataaaatatttttattctctttctctctttgatggtctcataaaaaatatttttattctctttctctctttgatggtctcataaaatatttttattctctttctctctttgatggtctcataaaaaatatttttattctctttctctctttgatggtctcataaaaaatattaaacctctttctgatggtgtcactaaaatatttttattctctttctctcttcaatggagtcataaaatatttttattctctttctctcttcgatggtctcacaaaaatattaaacctctttctgatggtgtcactaaaatatttttattctctttctct

---

What is claimed is:

1. A vaccine composition comprising a reconstituted recombinant synthetic modified vaccinia Ankara (rsMVA) virus, the rsMVA comprising:

(i) a full-length synthetic MVA (sMVA) genome;

(ii) a first DNA sequence encoding a severe acute respiratory syndrome coronavirus-2 (SARS-COV-2) Nucleocapsid (N) protein, wherein the first DNA sequence is inserted in a first insertion site of the full-length sMVA genome; and (iii) a second DNA sequence encoding a SARS-COV-2 Spike(S) protein, wherein the second DNA sequence is inserted in a second insertion site of the full-length sMVA genome, wherein the first DNA sequence encodes an amino acid sequence of SEQ ID NO: 10, and wherein the rsMVA is reconstituted from homologous recombination of three DNA fragments, F1, F2, and F3, wherein:

6. The vaccine composition of claim 1, wherein the second insertion site is selected from the group consisting of Del2, Del3, intergenic region (IGR) between open reading frame (ORF) 44L and 45L (IGR 44/45), intergenic region (IGR) between open reading frame (ORF) 64L and 65L (IGR 64/65), intergenic region (IGR) between open reading frame (ORF) 69R and 70L (IGR69/70), and Thymidine Kinase (TK) gene insertion site, wherein the open reading frame numbers are based on MVA strain Antoine (Accession No. U94848).

7. The vaccine composition of claim 6, wherein the second insertion site is Del3.

8. The vaccine composition of claim 1, wherein the first DNA sequence is SEQ ID NO: 9.

9. A method of inducing an immune response to a SARS-COV-2 virus in a human subject in need thereof comprising administering to the subject a vaccine composition comprising a reconstituted recombinant synthetic modified vaccinia Ankara (rsMVA) virus, the rsMVA comprising:

(i) a full-length synthetic MVA (sMVA) genome;

(ii) a first DNA sequence encoding a SARS-COV-2 Nucleocapsid (N) protein, wherein the first DNA sequence is inserted in a first insertion site of the full-length sMVA genome; and (iii) a second DNA sequence encoding a SARS-COV-2 Spike(S) protein, wherein the second DNA sequence is inserted in a second insertion site of the full-length sMVA genome, wherein the first DNA sequence encodes an amino acid sequence of SEQ ID NO: 10, and wherein the rsMVA is reconstituted from homologous recombination of three circular DNA fragments, F1, F2, and F3, wherein:

F1 comprises a first partial sequence of the full-length sMVA genome and the first DNA sequence encoding the SARS-COV-2 N protein;

F2 comprises a second partial sequence of the full-length sMVA genome; and

F3 comprises a third partial sequence of the full-length sMVA genome and the second DNA sequence encoding SARS-COV-2 S protein;

and wherein an MVA terminal hairpin loop (HL) sequence flanked by MVA concatemeric resolution (CR) sequences (CR/HL/CR) is added to both ends of each of F1, F2, and F3.

10. The method of claim 9, wherein the full-length sMVA genome comprises a nucleotide sequence identical to or having over 99% sequence identity to MVA strain Antoine (Accession No. U94848).

11. The method of claim 9, wherein the full length sMVA genome comprises a nucleotide sequence identical to or having over 99% sequence identity to MVA strain Acambis (Accession No. AY603355).

12. The method of claim 9, wherein the first insertion site is selected from the group consisting of Del2, Del3, intergenic region (IGR) between open reading frame (ORF) 44L and 45L (IGR 44/45), intergenic region (IGR) between open reading frame (ORF) 64L and 65L (IGR 64/65), intergenic region (IGR) between open reading frame (ORF) 69R and 70L (IGR69/70), and Thymidine Kinase (TK) gene insertion site, wherein the open reading frame numbers are based on MVA strain Antoine (Accession No. U94848).

13. The method of claim 12, wherein the first insertion site is Del2.

14. The method of claim 9, wherein the second insertion site is selected from the group consisting of Del2, Del3, intergenic region (IGR) between open reading frame (ORF) 44L and 45L (IGR 44/45), intergenic region (IGR) between open reading frame (ORF) 64L and 65L (IGR 64/65), intergenic region (IGR) between open reading frame (ORF) 69R and 70L (IGR69/70), and Thymidine Kinase (TK) gene insertion site, wherein the open reading frame numbers are based on MVA strain Antoine (Accession No. U94848).

15. The method of claim 14, wherein the second insertion site is Del3.

16. The method of claim 10, wherein the first DNA sequence is SEQ ID NO: 9.

17. A method of preventing a SARS-COV-2 virus infection in a human subject in need thereof comprising administering to the subject a vaccine composition comprising a reconstituted recombinant synthetic modified vaccinia Ankara (rsMVA) virus, the rsMVA comprising:

(i) a full-length synthetic MVA (sMVA) genome;

(ii) a first DNA sequence encoding a SARS-COV-2 Nucleocapsid (N) protein, wherein the first DNA sequence is inserted in a first insertion site of the full-length sMVA genome; and (iii) a second DNA sequence encoding a SARS-COV-2 Spike(S) protein, wherein the second DNA sequence is inserted in a second insertion site of the full-length sMVA genome;

wherein the first DNA sequence encodes an amino acid sequence of SEQ ID NO: 10, and wherein the rsMVA is reconstituted from homologous recombination of three circular DNA fragments, F1, F2, and F3, wherein:

F1 comprises a first partial sequence of the full-length sMVA genome and the first DNA sequence encoding the SARS-COV-2 N protein;

F2 comprises a second partial sequence of the full-length sMVA genome; and

F3 comprises a third partial sequence of the full-length sMVA genome and the second DNA sequence encoding SARS-COV-2 S protein;

and wherein an MVA terminal hairpin loop (HL) sequence flanked by MVA concatemeric resolution (CR) sequences (CR/HL/CR) is added to both ends of each of F1, F2, and F3.

18. The method of claim 17, wherein the full-length sMVA genome comprises a nucleotide sequence identical to or having over 99% sequence identity to MVA strain Antoine (Accession No. U94848).

19. The method of claim 17, wherein the full length sMVA genome comprises a nucleotide sequence identical to or having over 99% sequence identity to MVA strain Acambis (Accession No. AY603355).

20. The method of claim 17, wherein the first insertion site is selected from the group consisting of Del2, Del3, intergenic region (IGR) between open reading frame (ORF) 44L and 45L (IGR 44/45), intergenic region (IGR) between open reading frame (ORF) 64L and 65L (IGR 64/65), intergenic region (IGR) between open reading frame (ORF) 69R and 70L (IGR69/70), and Thymidine Kinase (TK) gene insertion site, wherein the open reading frame numbers are based on MVA strain Antoine (Accession No. U94848).

21. The method of claim 20, wherein the first insertion site is Del2.

22. The method of claim 17, wherein the second insertion site is selected from the group consisting of Del2, Del3, intergenic region (IGR) between open reading frame (ORF) 44L and 45L (IGR 44/45), intergenic region (IGR) between open reading frame (ORF) 64L and 65L (IGR 64/65), intergenic region (IGR) between open reading frame (ORF) 69R and 70L (IGR69/70), and Thymidine Kinase (TK) gene insertion site, wherein the open reading frame numbers are based on MVA strain Antoine (Accession No. U94848).

23. The method of claim 22, wherein the second insertion site is Del3.

24. The method of claim 19, wherein the first DNA sequence is SEQ ID NO:9.

* * * * *